US009833502B2

(12) United States Patent
Chen et al.

(10) Patent No.: US 9,833,502 B2
(45) Date of Patent: Dec. 5, 2017

(54) MALARIA ANTIGENS AND METHODS OF USE

(71) Applicant: GenVec, Inc., Gaithersburg, MD (US)

(72) Inventors: Ping Chen, Potomac, MD (US); Duncan McVey, Derwood, MD (US); Douglas Brough, Gaithersburg, MD (US); Joseph Bruder, Gaithersburg, MD (US)

(73) Assignee: GenVec, Inc., Gaithersburg, MD (US)

( * ) Notice: Subject to any disclaimer, the term of this patent is extended or adjusted under 35 U.S.C. 154(b) by 0 days.

(21) Appl. No.: 14/441,988

(22) PCT Filed: Nov. 12, 2013

(86) PCT No.: PCT/US2013/069620
§ 371 (c)(1),
(2) Date: May 11, 2015

(87) PCT Pub. No.: WO2014/075047
PCT Pub. Date: May 15, 2014

(65) Prior Publication Data
US 2015/0297699 A1    Oct. 22, 2015

Related U.S. Application Data

(60) Provisional application No. 61/725,248, filed on Nov. 12, 2012.

(51) Int. Cl.
*A61K 39/015* (2006.01)
*A61K 39/00* (2006.01)

(52) U.S. Cl.
CPC .... *A61K 39/015* (2013.01); *A61K 2039/5256* (2013.01); *A61K 2039/53* (2013.01)

(58) Field of Classification Search
None
See application file for complete search history.

(56) References Cited

U.S. PATENT DOCUMENTS

2008/0248060 A1* 10/2008 Bruder ................. A61K 39/015
424/199.1

FOREIGN PATENT DOCUMENTS

| WO | WO 2007/027860 A2 | 3/2007 |
| WO | WO 2007/041216 A2 | 4/2007 |
| WO | WO 2008/086386 A2 | 7/2008 |

OTHER PUBLICATIONS

Bowie et al. (Science, 1990, 247:1306-1310).*
Greenspan et al. (Nature Biotechnology 7: 936-937, 1999).*
Agnandji et al., "First Results of Phase 3 Trial of RTS,S/AS01 Malaria Vaccine in African Children," *N. Engl. J. Med.*, 365: 1863-1875 (2011).
Carlton et al., "Genome sequence and comparative analysis of the model rodent malaria parasite *Plasmodium yoelii yoelii*," *Nature*, 419: 512-519 (2002).
Carlton et al., "Comparative genomics of the neglected human malaria parasite *Plasmodium vivax*," *Nature*, 455(7214): 757-763 (2008).
Carvalho et al., "Malaria vaccine: candidate antigens, mechanisms, constraints and prospects," *Scand. J. Immunol.*, 56: 327-343 (2002).
Cesares et al., "The RTS,S malaria vaccine," *Vaccine*, 28: 4880-4894 (2010).
Clyde et al., "Immunization of man against sporozite-induced falciparum malaria," *Am. J. Med. Sci.*, 266(3):169-177 (1973).
Crompton et al., "Advances and challenges in malaria vaccine development," *J. Clin. Invest.*, 120: 4168-4178 (2010).
Dharia et al., "Whole-genome sequencing and microarray analysis of ex vivo Plasmodium vivax reveal selective pressure on putative drug resistance genes," *Proc. Natl. Acad. Sci. USA*, 107: 20045-20050 (2010).
Gardner et al., "Genome sequence of the human malaria parasite Plasmodium falciparum," *Nature*, 419: 498-511 (2002).
Graves and Gelband, "Vaccines for preventing malaria," *Cochrane Database Syst. Rev.*, 1: CD000129 (2003).
Greenwood and Alonso, "Malaria vaccine trials," *Chem. Immunol.*, 80: 366-395 (2002).
Hoffman et al., "Protection of humans against malaria by immunization with radiation-attenuated Plasmodium falciparum sporozoites," *J. Infect. Dis.*, 185: 1155-1164 (2002).
Ivanov et al., "The adenosine deaminases of Plasmodium vivax and Plasmodium falciparum exhibit surprising differences in ligand specificity," *Journal of Molecular Graphics and Modelling*, 35: 43-48 (2012).
Kester et al., "Randomized, double-blind, phase 2a trial of falciparum malaria vaccines RTS,S/AS01B and RTS,S/AS02A in malaria-naive adults: safety, efficacy, and immunologic associates of protection," *J. Infect. Dis.*, 200: 337-346 (2009).
Kester et al., "A phase I/IIa safety, immunogenicity, and efficacy bridging randomized study of a two-dose regimen of liquid and lyophilized formulations of the candidate malaria vaccine RTS,S/AS02A in malaria-naïve adults," *Vaccine*, 25: 5359-5366 (2007).
Kester et al., "Phase 2a trial of 0, 1, and 3 month and 0, 7, and 28 day immunization schedules of malaria vaccine RTS,S/AS02 in malaria-naïve adults at the Walter Reed Army Institute of Research," *Vaccine*, 26: 2191-2202 (2008).
Kumar et al., "The circumsporozoite protein is an immunodominant protective antigen in irradiated sporozoites," *Nature*, 444: 937 (2006).
Mehlin et al., "Heterologous expression of proteins from Plasmodium falciparum: Results from 1000 genes," *Molecular and Biochemical Parasitology*, 148(2): 144-160 (2006).
Moore et al., "Malaria vaccines: where are we and where are we going?" *Lancet Infect. Dis.*, 2: 737-743 (2002).

(Continued)

*Primary Examiner* — Brian Gangle
(74) *Attorney, Agent, or Firm* — Leydig, Voit & Mayer, Ltd.

(57) ABSTRACT

The invention is directed to a composition comprising one or more polypeptides or one or more nucleic acid sequences that can induce a protective immune response against *Plasmodium* species that infect humans. The invention also is directed to a method of using such compositions to induce a protective immune response against a *Plasmodium* parasite in a mammal.

23 Claims, No Drawings

(56) References Cited

OTHER PUBLICATIONS

Moorthy and Hill, "Malaria vaccines," *Br. Med. Bull.*, 62: 59-72 (2002).
Neafsey et al., "The malaria parasite Plasmodium vivax exhibits greater genetic diversity than Plasmodium falciparum," *Nature Genetics*, 44: 1046-1050 (2012).
Nussenzwig and Nussenzweig, "Rationale for the development of an engineered sporozoite malaria vaccine," *Adv. Immunol.*, 45: 283-334 (1989).
Nussenzwig et al., "Protective immunity produced by the injection of x-irradiated sporozoites of plasmodium berghei," *Nature*, 216: 160-162 (1967).
Richie and Saul, "Progress and challenges for malaria vaccines," *Nature*, 415: 694-701 (2002).
Rieckmann et al., "Letter: Sporozoite induced immunity in man against an Ethiopian strain of Plasmodium falciparum," *Trans R. Soc. Trop. Med. Hyg.*, 68: 258 (1974).
Sanni et al., *Methods in Molecular Medicine*, 72: Malaria Methods and Protocols: 57-76 (2002).
Schofield et al., "Gamma interferon, CD8+ T cells and antibodies required for immunity to malaria sporozoites," *Nature*, 330(6149): 664-666 (1987).
Schwartz et al., "A review of malaria vaccine clinical projects based on the WHO rainbow table," *Malaria Journal*, 11(1): 11 (2012).
Stoute et al., "A preliminary evaluation of a recombinant circumsporozoite protein vaccine against Plasmodium falciparum malaria. RTS,S Malaria Vaccine Evaluation Group," *N. Engl. J. Med.*, 336: 86-91 (1997).
Tyagi et al., "Vaccination Strategies against Malaria: novel carrier(s) more than a tour de force," *J. Control Release*, 162(1): 242-254 (2012).
UNIPROT Accession No. A5KE01, "Adenosine deaminase, putative." (2007).
UNIPROT Accession No. Q81JA9, "Adenosine deaminase, putative." (2003).
Vaughan et al., "Malaria vaccine development: persistent challenges," *Curr. Opin., Immunol.*, 24(3): 324-331 (2012).
Voza et al., "Intradermal immunization of mice with radiation-attenuated sporozoites of Plasmodium yoelii induces effective protective immunity," *Malaria Journal*, 9: 362 (2010).
Weiss et al., "CD8+ T cells (cytotoxic/suppressors) are required for protection in mice immunized with malaria sporozoites," *Proc. Natl. Acad. Sci. USA*, 85: 573 (1988).
Yadav et al., "Purification and characterization of plasmodium yoleii adenosine deaminase," *Experimental Parasitology*, 129(4): 368-374 (2011).
Zeeshan et al., "Genetic variation in the Plasmodium falciparum circumsporozoite protein in India and its relevance to RTS,S malaria vaccine," *PLoS ONE*, 7(8): e43430 (2012).
International Preliminary Report on Patentability, Application No. PCT/US2013/069620, dated May 21, 2015.

* cited by examiner

MALARIA ANTIGENS AND METHODS OF USE

STATEMENT REGARDING FEDERALLY SPONSORED RESEARCH AND DEVELOPMENT

This invention was made with Government support under Grant Number 1R43AQ1084269-01 awarded by the National Institute of Allergy and Infectious Diseases (NI-AID). The Government has certain rights in this invention.

INCORPORATION-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 828,208 Byte ASCII (Text) file named "720344Sequence-Listing_ST25" created on Nov. 21, 2016

BACKGROUND OF THE INVENTION

Malaria is one of the most devastating parasitic diseases affecting humans. The Centers for Disease Control (CDC) estimate that over three billion people live in areas at risk of malaria transmission in 106 countries and territories (e.g., parts of Africa, Asia, the Middle East, Central and South America, Hispaniola, and Oceania). The World Health Organization (WHO) and CDC also estimate that in 2010, malaria caused over 200 million clinical episodes 655,000 deaths, with the majority of deaths occurring in Africa. About 86% of the malaria deaths in 2010 occurred in children. On average, 1,500 cases of malaria are reported annually in the United States, and malaria is a major health concern to U.S. military personnel deployed to tropical regions of the world. For example, in August 2003, 28% of the 26th Marine Expeditionary Unit and Joint Task Force briefly deployed to Monrovia, Liberia, were infected with the malaria parasite *Plasmodium falciparum*. In addition, one 157-man Marine Expeditionary Unit sustained a 44% malaria casualty rate over a 12-day period while stationed at Robert International Airport in Monrovia. In all conflicts during the past century conducted in malaria endemic areas, malaria has been the leading cause of casualties, exceeding enemy-inflicted casualties in its impact on "person-days" lost from duty.

To combat malaria during U.S. military operations, preventive drugs, insect repellants, and barriers have been used with some success, but developing drug resistance by the malaria parasite and insecticide resistance by mosquito vectors has limited the efficacy of these agents. Moreover, the logistical burden and side effects associated with the use of these agents often is associated with high non-compliance rates. Vaccines are the most cost effective and efficient therapeutic interventions for infectious diseases. In this regard, vaccination has the advantage of administration prior to military deployment and likely reduction in non-compliance risks. However, decades of research and development directed to a malaria vaccine have not proven successful. Recent efforts have focused on developing vaccines against several specific malaria genes and delivery vector systems including adenovirus, poxvirus, and plasmids. The current status of malaria vaccine development and clinical trials is reviewed in, for example, Vaughan et al., *Curr. Opin. Immunol.*, 24(3): 324-331 (2012); Schwartz et al., *Malaria Journal*, 11: 11 (2012); Tyagi et al., *J. Control Release*, 162(1): 242-254 (2012); Graves and Gelband, *Cochrane Database Syst. Rev.*, 1: CD000129 (2003); Moore et al., *Lancet Infect. Dis.*, 2: 737-743 (2002); Carvalho et al., *Scand. J. Immunol.*, 56: 327-343 (2002); Moorthy and Hill, *Br. Med. Bull.*, 62: 59-72 (2002); Greenwood and Alonso, *Chem. Immunol.*, 80: 366-395 (2002); and Richie and Saul, *Nature*, 415: 694-701 (2002).

An unprecedented quantity of genomic data has emerged from the sequencing and functional genomic analysis of many disease-causing organisms, including malaria. Indeed, it has been determined that the parasite *Plasmodium falciparum* encodes an estimated 5,268 putative proteins (see Gardner et al., *Nature*, 419: 498-511 (2002)). This genetic information can be exploited for the systematic discovery of novel antigens for vaccine development. In the past, target antigens for genetic vaccines have been identified based mainly on their abundance in the pathogen of interest and their susceptibility to neutralization by antibodies generated in infected individuals and animal models. This approach has failed to yield effective vaccines against many of the most devastating infectious diseases.

With regard to malaria, less than 5% of the *Plasmodium falciparum* genome is represented by antigens currently in clinical development. However, a number of potential vaccine candidates targeted against pre-erythrocytic, erythrocytic and sexual stages of *P. falciparum* are under various stages of clinical development (see, e.g., Crompton et al., *J. Clin. Invest.*, 120: 4168-4178 (2010)). The RTS,S vaccine is the most clinically advance malaria vaccine. RTS,S is a pre-erythrocytic stage vaccine based on the *P. falciparum*-circumsporozoite protein (CSP), and provides protective efficacy in phase II clinical trials of 30-50% against pathogen challenge (see, e.g., Cesares et al., *Vaccine*, 28: 4880-4894 (2010); Stoute et al., *N Engl. J. Med.*, 336: 86-91 (1997); Kester et al., *Vaccine*, 26: 2191-2202 (2008); Kester et al., *J. Infect. Dis.*, 200: 337-346 (2009); Kester et al., *Vaccine*, 25: 5359-5366 (2007); and Zeeshan et al., *PLoS ONE*, 7(8): e43430 (2012)). Initial results of phase III clinical trials show that the RTS,S vaccine provides protective efficacies of 56% and 47% against clinical and severe malaria, respectively, in African children age 5 to 17 months (see, e.g., Agnandji et al., *N Engl. J. Med.*, 365: 1863-1875 (2011)). The protection afforded by this protein-based vaccine, however, is short lived (3-8 weeks).

Other recent efforts at developing a malaria vaccine have focused on several specific genes and their delivery using various different vector systems including adenovirus, poxvirus, and plasmid DNA. It is not apparent, however, whether these recombinant vaccines are effective against malaria, or if they encode the most potent protective antigens. It is clear that protective antigens do exist for the malaria pathogen *Plasmodium falciparum*, as evidenced by the ability of irradiated sporozoites to induce cellular immune responses in human subjects and robust sterile protection against parasite challenge (see, e.g., Nussenzweig and Nussenzweig, *Adv. Immunol.*, 45: 283-334 (1989), and Hoffnan et al., *J. Infect. Dis.*, 185: 1155-1164 (2002)).

Thus, there remains a need for compositions containing improved antigens that induce potent protective immunity against challenge with malaria-causing parasites. The invention provides such a composition. This and other advantages of the invention will become apparent from the detailed description provided herein.

BRIEF SUMMARY OF THE INVENTION

The invention provides a composition comprising a pharmaceutically acceptable carrier and one or more isolated polypeptides, wherein each of the one or more isolated polypeptides comprises (a) the amino acid sequence of KKERYXIWXRXPKXELHCHLD (SEQ ID NO: 1), wherein X is a lysine (K) residue, a glutamic acid (E) residue, an arginine (R) residue, an isoleucine (I) residue, a leucine (L) residue, a cysteine (C) residue, or a valine (V) residue, (b) the amino acid sequence of KYKEGVVLMEFRYSP (SEQ ID NO: 2), (c) an amino acid sequence comprising at least 20 contiguous amino acid residues of the sequence EDLAKXAVXXKYKEGVVLMEFRYSP (SEQ ID NO: 3), wherein X is a histidine (H) residue, a tryptophan (W) residue, a phenylalanine (F) residue, an isoleucine (I) residue, an asparagine (N) residue, or a glutamic acid (E) residue, or (d) an amino acid sequence comprising at least 20 contiguous amino acid residues of the sequence KSMDTHPIRXLYDAGVKVSVNSDDPGMFL (SEQ ID NO: 4), wherein X is a glutamine (Q) residue, a methionine (M) residue, or a lysine (K) residue, and wherein each of the one or more isolated polypeptides induces a protective immune response against *Plasmodium falciparum* and/or *Plasmodium vivax* in a mammal.

The invention provides a composition comprising a pharmaceutically acceptable carrier and one or more isolated polypeptides, wherein each of the one or more isolated polypeptides comprises (a) an amino acid sequence comprising at least 20 contiguous amino acid residues of the sequence MKKDREPIDEDEMRITSTGRMTNYVNYGAKILG (SEQ ID NO: 20), (b) an amino acid sequence comprising at least 20 contiguous amino acid residues of the sequence KIKATGNAIGKAVTLAEIIKRRFKGLHQIT (SEQ ID NO: 21), or (c) an amino acid sequence comprising SEQ ID NO: 22, and wherein each of the one or more isolated polypeptides induces a protective immune response against *Plasmodium falciparum* and/or *Plasmodium vivax* in a mammal.

The invention provides a composition comprising a pharmaceutically acceptable carrier and one or more isolated polypeptides, wherein each of the one or more isolated polypeptides comprises (a) an amino acid sequence which comprises at least 40 contiguous amino acid residues of the sequence MGKEKTHINLVVIGHVDSGKSTTTGHIIYKLGGIDRRTIEKFEKESAEMGKGSFKYAWVLDKLKAERERGITIDIALWKFETPRYFFTVIDAPGHKDFIKNMITGTSQADVALLVVPAEVGGFEGAFSKEGQTKEHALLAFTLGVKQIVVGVNKMDTVKYSEDRYEEIKKEV (SEQ ID NO: 30), (b) an amino acid sequence which comprises at least 55 contiguous amino acid residues of the sequence DYLKKVGYQADKVDFIPISGFEGDNLIEKSDKTPWYKGRTLIEALDTMEPPKRPYDKPLRIPLQGVYKIGGIGTVPVGRVETGILKAGMVLNFAPSAVVSECKSVEMHKEVLEEARPGDNIGFNVKNVSVKEIKRGYVASDTKNEPAKGCSKFTAQVIILNHPGEIKNGY (SEQ ID NO: 31), (c) the amino acid sequence of HISCKFLNIDSKIDKRSGKVVEENPK (SEQ ID NO: 32), or (d) an amino acid sequence which comprises at least 20 contiguous amino acid residues of the sequence LEPKKPMVVETFTEYPPLGRFAIRDMRQTIAVGIIK (SEQ ID NO: 33), and wherein each of the one or more isolated polypeptides induces a protective immune response against *Plasmodium falciparum* and/or *Plasmodium vivax* in a mammal.

The invention provides a composition comprising a pharmaceutically acceptable carrier and one or more isolated polypeptides, wherein each of the one or more isolated polypeptides comprises (a) the amino acid sequence of GKVAIILXGKHMGKRCIITK (SEQ ID NO: 40), wherein X is a threonine (T) residue or a serine (S) residue, (b) the amino acid sequence of GKHMGKRCIITKXLXSGLLAVVGPYE (SEQ ID NO: 41), wherein X is an isoleucine (I) residue, a valine (V) residue, an asparagine (N) residue, or a threonine (T) residue, (c) the amino acid sequence of SGLLAVVGPYEXNGVPLKRV (SEQ ID NO: 42), wherein X is a valine (V) residue or an isoleucine (I) residue, and wherein each of the one or more isolated polypeptides induces a protective immune response against *Plasmodium falciparum* and/or *Plasmodium vivax* in a mammal.

The invention provides a composition comprising a pharmaceutically acceptable carrier and one or more isolated polypeptides, wherein each of the one or more isolated polypeptides comprises (a) an amino acid sequence comprising at least 20 contiguous amino acid residues of the sequence LEKKMQLKKEGKLLSAKAKEEKKK (SEQ ID NO: 55), (b) an amino acid sequence comprising at least 21 contiguous amino acid residues of the sequence IVCILGHVDTGKTKLLDKLRHTNVQDNEAGGITQQIGATFFPKD (SEQ ID NO: 56), (c) an amino acid sequence comprising at least 21 contiguous amino acid residues of the sequence SKGIMIIDTPGHESFYNLRKRGSSLCDIAILVIDLMHGLEQQTKESIQILKQRNCPFVIALNKIDRLYMW (SEQ ID NO: 57), (d) an amino acid sequence comprising at least 20 contiguous amino acid residues of the sequence KLECTVLEVKNIEGLGTTIDVILTNG (SEQ ID NO: 58), (e) the amino acid sequence of GVGLYVMASTLGSLEALLIFL (SEQ ID NO: 59), and (f) an amino acid sequence comprising at least 20 contiguous amino acid residues of the sequence MTDVSDVFNHVDKXGVGLYVMASTLGSLEALLIFL (SEQ ID NO: 60), wherein X is a serine (S) residue or a threonine (T) residue, and wherein each of the one or more isolated polypeptides induces a protective immune response against *Plasmodium falciparum* and/or *Plasmodium vivax* in a mammal.

The invention provides a composition comprising a pharmaceutically acceptable carrier and one or more isolated polypeptides, wherein each of the one or more isolated polypeptides comprises (a) the amino acid sequence of NLFFAKQVIPNACATQAILSI (SEQ ID NO: 69), or (b) the amino acid sequence of NFDSXMKGLTLSNCXFLRNIHN (SEQ ID NO: 70), wherein X is a serine (S) residue, a threonine (T) residue, or an asparagine (N) residue, and wherein each of the one or more isolated polypeptides induces a protective immune response against *Plasmodium falciparum* and/or *Plasmodium vivax* in a mammal.

The invention provides a composition comprising a pharmaceutically acceptable carrier and one or more isolated polypeptides, wherein each of the one or more isolated polypeptides comprises (a) the amino acid sequence of SGWKFEEQEGDVNMVLTKNVD (SEQ ID NO: 80), (b) an amino acid sequence comprising at least 20 contiguous amino acid residues of the sequence IIDFQLVSPFQAEGENEAQAEMTDFSVTVEKPN (SEQ ID NO: 81), (c) an amino acid sequence comprising at least 20 contiguous amino acid residues of the sequence GGITFYCTTLQNDEKFRYMIGNVKYYKNEEGKNSVS (SEQ ID NO: 82), and (d) an amino acid sequence comprising at least 21 contiguous amino acid residues of the sequence YNGPEFEDLDDSLQTSLDEWLANLGVDSELCDFIDSCSIDKEQREYM (SEQ ID NO: 83), and wherein each of the one or more isolated polypeptides induces a protective immune response against *Plasmodium falciparum* and/or *Plasmodium vivax* in a mammal.

The invention provides a composition comprising a pharmaceutically acceptable carrier and one or more isolated polypeptides, wherein each of the one or more isolated polypeptides comprises the amino acid sequence of SEQ ID NO: 90, SEQ ID NO: 91, SEQ ID NO: 92, SEQ ID NO: 93, or SEQ ID NO: 202, and wherein each of the one or more isolated polypeptides induces a protective immune response against *Plasmodium falciparum* and/or *Plasmodium vivax* in a mammal.

The invention provides a composition comprising a pharmaceutically acceptable carrier and one or more isolated polypeptides, wherein each of the one or more isolated polypeptides comprises the amino acid sequence of SEQ ID NO: 98, SEQ ID NO: 99, or SEQ ID NO: 100, and wherein each of the one or more isolated polypeptides induces a protective immune response against *Plasmodium falciparum* and/or *Plasmodium vivax* in a mammal.

The invention provides a composition comprising a pharmaceutically acceptable carrier and one or more isolated polypeptides, wherein each of the one or more isolated polypeptides comprises (a) the amino acid sequence of LLKHGWCEMLKGGVIMDVKX (SEQ ID NO: 104), wherein X is an asparagine (N) residue or a serine (S) residue, (b) an amino acid sequence comprising at least 20 contiguous amino acid residues of the sequence VEQAKI-AEXAGAIGVMVLENIPSELR (SEQ ID NO: 105), wherein X is a lysine (K) residue or a glutamic acid (E) residue, (c) an amino acid sequence comprising at least 20 contiguous amino acid residues of the sequence SINVLAK-VRIGHFVEAQILEELK (SEQ ID NO: 106), (d) an amino acid sequence comprising at least 27 contiguous amino acid residues of the sequence KHKFKTPFVCGCTNLGEALR-RXSEGASMIRTKGEAGTGNII (SEQ ID NO: 107), wherein X is an isoleucine (I) residue or a methionine (M) residue, (e) an amino acid sequence comprising at least 20 contiguous amino acid residues of the sequence ATPADAAMCMQLGMDGVFVGSGIFESENP (SEQ ID NO: 108), or (f) an amino acid sequence comprising at least 20 contiguous amino acid residues of the sequence LPV-VNFAAGGXATPADAAMCMQLGMDGVFVGS-GIFESENP (SEQ ID NO: 109), wherein X is an isoleucine (I) residue or a valine (V) residue, and wherein each of the one or more isolated polypeptides induces a protective immune response against *Plasmodium falciparum* and/or *Plasmodium vivax* in a mammal.

The invention provides composition comprising a pharmaceutically acceptable carrier and one or more isolated nucleic acid sequences, wherein each of the one or more isolated nucleic acid sequences encodes a polypeptide comprising the amino acid sequence of any one of SEQ ID NO: 1-SEQ ID NO: 16, SEQ ID NO: 20-SEQ ID NO: 26, SEQ ID NO: 30-SEQ ID NO: 36, SEQ ID NO: 40-SEQ ID NO: 51, SEQ ID NO: 55-SEQ ID NO: 65, SEQ ID NO: 69-SEQ ID NO: 76, SEQ ID NO: 80-SEQ ID NO: 86, SEQ ID NO: 90-SEQ ID NO: 93, SEQ ID NO: 98-SEQ ID NO: 100, SEQ ID NO: 104-SEQ ID NO: 118, SEQ ID NO: 202, SEQ ID NO: 205, SEQ ID NO: 207-SEQ ID NO: 209, SEQ ID NO: 211, or SEQ ID NO: 212, and wherein each of the one or more isolated polypeptides induces a protective immune response against *Plasmodium falciparum* and/or *Plasmodium vivax* in a mammal.

DETAILED DESCRIPTION OF THE INVENTION

The invention is predicated, at least in part, on the identification of antigenic polypeptides from *Plasmodium* parasites that provide protective immunity in mammals against challenge with malaria-causing parasites. In this respect, the invention provides a composition comprising a pharmaceutically acceptable carrier and one or more isolated polypeptides or nucleic acid sequences, each of which comprises or encodes, respectively, a *Plasmodium* amino acid sequence, wherein the *Plasmodium* amino acid sequence induces a protective immune response against *Plasmodium falciparum* and/or *Plasmodium vivax* in a mammal. The one or more polypeptides are "isolated" in that they are removed from their natural environment (i.e., a *Plasmodium* parasite).

Each of the one or more *Plasmodium* amino acid sequences is a *Plasmodium* antigen. An "antigen" is a molecule that triggers an immune response in a mammal. An "immune response" can entail, for example, antibody production and/or the activation of immune effector cells. An antigen in the context of the invention can comprise any subunit, fragment, or epitope of any proteinaceous or non-proteinaceous (e.g., carbohydrate or lipid) molecule which provokes an immune response in a mammal. By "epitope" is meant a sequence of an antigen that is recognized by an antibody or an antigen receptor. Epitopes also are referred to in the art as "antigenic determinants."

A *Plasmodium* antigen in the context of the invention can comprise any proteinaceous *Plasmodium* molecule or portion thereof that provokes a *Plasmodium*-related immune response in a mammal. A "*Plasmodium* molecule" is a molecule that is a part of a *Plasmodium* parasite, is encoded by a nucleic acid sequence of a *Plasmodium* parasite, or is derived from or synthetically based upon any such molecule. Administration of a *Plasmodium* antigen that provokes an immune response in accordance with the invention preferably leads to protective immunity against *Plasmodium*. In this regard, an "immune response" to *Plasmodium* is an immune response to any one or more *Plasmodium* antigens.

The one or more *Plasmodium* amino acid sequences can be obtained or derived from any *Plasmodium* species. Preferably, the one or more *Plasmodium* amino acid sequences are derived or obtained from a *Plasmodium* species that infects humans and causes malaria. Human-infecting *Plasmodium* species include *P. malariae, P. ovale, P. knowlesi, P. vivax*, and *P. falciparum*. *P. vivax* and *P. falciparum* are the most common species, while *P. falciparum* is the most deadly species of *Plasmodium* in human.

Alternatively, each of the one or more *Plasmodium* amino acid sequences can be an ortholog of an amino acid sequence from a human-infecting *Plasmodium* species. "Orthologs" or "orthologous genes" are nucleic acid or amino acid sequences that evolved from a common ancestral gene by speciation, and typically retain the same function in the course of evolution. In other words, when a species diverges into two separate species, the copies of a single gene in the two resulting species are said to be "orthologous." *Plasmodium* species that infect non-human animals and contain orthologous genes include, for example, rodent-infecting species such as *P. vinckei, P. chabaudi, P. yoelii*, and *P. berghei*; and non-human primate-infecting species such as *P. knowlesi, P. cynomolgi, P. simiovale, P. fieldi, P. inui, P. brasilianum, P. billbrayi, P. billcollinsi, P. bouillize, P. brasilianum, P. bucki, P. cercopitheci, P. coatneyi, P. coulangesi, P. eylesi, P. fieldi, P. foleyi, P. fragile, P. inui, P. gaboni, P. georgesi, P. girardi*, and *P. gonderi*. In order to advance vaccine discovery, the genomes of a number of *Plasmodium* species have been sequenced. For example, the complete *P. falciparum* genome has been sequenced and is disclosed in Gardner et al., *Nature*, 419: 498-511 (2002). The complete *P. vivax* genome has been sequenced and is disclosed in Neafsey et al., *Nature Genetics*, 44: 1046-1050 (2012); Carlton et al., *Nature*, 455: 757-763 (2008); and Dharia et al., *Proc. Natl. Acad. Sci. USA*, 107: 20045-20050 (2010). In addition, the complete *P. yoelii* genome sequence is disclosed in Carlton et al., *Nature*, 419: 512-9 (2002).

Mouse models of malaria infection, in which *P. yoelii* is the infecting parasite, have been generated (see, e.g., Wiersch et al., *Methods in Molecular Medicine,* 72: Malaria Methods and Protocols: 57-76 (2002); and Voza et al., *Malaria Journal,* 9: 362 (2010)), and have been established as reliable models for pre-erythrocytic stage *P. falciparum* vaccine development (see, e.g., Nussenzweig et al., *Nature,* 216: 160 (1967); Clyde et al., *Am. J. Med. Sci.,* 266: 169 (1973); Roeckmann et al., *Trans R. Soc. Trop. Med. Hyg.,* 68: 258 (1974); Hoffman et al., *J. Inf. Dis.,* 185: 1155 (2002); Schofield et al., *Nature,* 330: 64 (1987); Weiss et al., *Proc. Natl. Acad. Sci. USA,* 85: 573 (1988); Kumar et al., *Nature,* 444: 937 (2006); Stoute et al., *N. Eng. J. Med.,* 336: 86 (1997)).

In one embodiment, the composition comprises a pharmaceutically acceptable carrier and one or more isolated polypeptides, wherein each of the one or more isolated polypeptides comprises: (a) the amino acid sequence of KKERYXIWXRXPKXELHCHLD (SEQ ID NO: 1), wherein X is a lysine (K) residue, a glutamic acid (E) residue, an arginine (R) residue, an isoleucine (I) residue, a leucine (L) residue, a cysteine (C) residue, or a valine (V) residue, (b) the amino acid sequence of KYKEGVVLMEFRYSP (SEQ ID NO: 2), (c) an amino acid sequence comprising at least 20 contiguous amino acid residues of the sequence EDLAKXAVXXKYKEGVVLMEFRYSP (SEQ ID NO: 3), wherein X is a histidine (H) residue, a tryptophan (W) residue, a phenylalanine (F) residue, an isoleucine (I) residue, an asparagine (N) residue, or a glutamic acid (E) residue, or (d) an amino acid sequence comprising at least 20 contiguous amino acid residues of the sequence KSMDTHPIRXLYDAGVKVSVNSDDPGMFL (SEQ ID NO: 4), wherein X is a glutamine (Q) residue, a methionine (M) residue, or a lysine (K) residue.

When the composition comprises an isolated polypeptide comprising the amino acid sequence of SEQ ID NO: 1, X can be any suitable amino acid residue, but preferably is a lysine (K) residue, a glutamic acid (E) residue, an arginine (R) residue, an isoleucine (I) residue, a leucine (L) residue, a cysteine (C) residue, or a valine (V) residue. In this respect, the isolated polypeptide can comprise, for example, the amino acid sequence of KKERYEIWRRIPKVELHCHLD (SEQ ID NO: 5), KKERYKIWKRLPKCELHCHLD (SEQ ID NO: 6), or KKERYKIWKRIPKCELHCHLD (SEQ ID NO: 7). When the composition comprises an amino acid sequence comprising at least 20 contiguous amino acid residues (e.g., 20, 21, 22, 23, 24, or 25 contiguous amino acid residues) of the sequence SEQ ID NO: 3, X can be any suitable amino acid residue, but preferably is a histidine (H) residue, a tryptophan (W) residue, a phenylalanine (F) residue, an isoleucine (I) residue, an asparagine (N) residue, or a glutamic acid (E) residue. In this respect, the isolated polypeptide can comprise, for example, an amino acid sequence comprising at least 20 contiguous amino acid residues of the sequence EDLAKWAVIEKYKEGVVLMEFRYSP (SEQ ID NO: 8), EDLAKHAVFNKYKEGVVLMEFRYSP (SEQ ID NO: 9), or EDLAKHAVFNKYKEGVVLMEFRYSP (SEQ ID NO: 10). In particular, the isolated polypeptide can comprise the amino acid sequence of EDLAKWAVIEKYKEGVVLMEFRYSP (SEQ ID NO: 8), EDLAKHAVFNKYKEGVVLMEFRYSP (SEQ ID NO: 9), or EDLAKHAVFNKYKEGVVLMEFRYSP (SEQ ID NO: 10). When the composition comprises an isolated polypeptide comprising at least 20 contiguous amino acid residues (e.g., 20, 21, 22, 23, 24, 25, 26, 27, 28, or 29 contiguous amino acid residues) of SEQ ID NO: 4, the isolated polypeptide can comprise, for example, at least 20 contiguous amino acid residues of the sequence KSMDTHPIRKLYDAGVKVSVNSDDPGMFL (SEQ ID NO: 11), KSMDTHPIRMLYDAGVKVSVNSDDPGMFL (SEQ ID NO: 12), or KSMDTHPIRQLYDAGVKVSVNSDDPGMFL (SEQ ID NO: 13). In particular, the isolated polypeptide can comprise the amino acid sequence of KSMDTHPIRKLYDAGVKVSVNSDDPGMFL (SEQ ID NO: 11), KSMDTHPIRMLYDAGVKVSVNSDDPGMFL (SEQ ID NO: 12), or KSMDTHPIRQLYDAGVKVSVNSDDPGMFL (SEQ ID NO: 13).

The composition can comprise one, two, three, or all four, of the aforementioned polypeptides alone or in any combination. In this respect, the composition can comprise any combination of any two of the aforementioned sequences, any combination of any three of the aforementioned sequences, or all four of the aforementioned sequences. In a preferred embodiment, the composition comprises an isolated polypeptide comprising the amino acid sequence of SEQ ID NO: 14, SEQ ID NO: 15, SEQ ID NO: 16, or SEQ ID NO: 209.

In another embodiment, the composition comprises a pharmaceutically acceptable carrier and one or more isolated polypeptides, wherein each of the one or more isolated polypeptides comprises (a) an amino acid sequence comprising at least 20 contiguous amino acid residues (e.g., 20, 21, 22, 23, 24, 25, 26, 27, 28, 29, 30, 31, 32, or 33 contiguous amino acid residues) of the sequence MKKDREPIDEDEMRITSTGRMTNYVNYGAKILG (SEQ ID NO: 20), (b) an amino acid sequence comprising at least 20 contiguous amino acid residues (e.g., 20, 21, 22, 23, 24, 25, 26, 27, 28, 29, or 30 contiguous amino acid residues) of the sequence KIKATGNAIGKAVTLAEIIKRRFKGLHQIT (SEQ ID NO: 21), or (c) the amino acid sequence of SEQ ID NO: 22.

When the composition comprises an isolated polypeptide comprising an amino acid sequence comprising at least 20 contiguous amino acid residues of SEQ ID NO: 20, the isolated polypeptide can comprise, for example, the amino acid sequence of SEQ ID NO: 20. When the composition comprises an isolated polypeptide comprising an amino acid sequence comprising at least 20 contiguous amino acid residues of SEQ ID NO: 21, the isolated polypeptide can comprise, for example, the amino acid sequence of SEQ ID NO: 21. When the composition comprises an isolated polypeptide comprising the amino acid sequence of SEQ ID NO: 22, the isolated polypeptide can comprise, for example, the amino acid sequence of KDAGYQPPLDEKYVKEMXPEEIVN (SEQ ID NO: 23), wherein X can be any suitable amino acid residue, but is preferably a serine (S) residue or a threonine (T) residue (i.e., KDAGYQPPLDEKYVKEMXPEEIVN (SEQ ID NO: 211) or KDAGYQPPLDEKYVKEMTPEEIVN (SEQ ID NO: 212)).

The composition can comprise one, two, or all three of the aforementioned polypeptides alone or in any combination. In this respect, the composition can comprise any combination of any two of the aforementioned sequences, or all three of the aforementioned sequences. In a preferred embodiment, the composition comprises an isolated polypeptide comprising the amino acid sequence of SEQ ID NO: 24, SEQ ID NO: 25, or SEQ ID NO: 26.

In another embodiment, the composition comprises a pharmaceutically acceptable carrier and one or more isolated polypeptides, wherein each of the one or more isolated polypeptides comprises (a) an amino acid sequence which comprises at least 40 contiguous amino acid residues of the sequence MGKEKTHINLVVIGHVDSGKSTTTGHII-YKLGGIDRRTIEKFEKESAEMGKGSFKYAWVLDKL- KAERERGITIDIALWKFETPRYFFTVIDAPGHKDFIKN-MITGTSQADVALLVVPAEVGGFEGAFSKEGQTKEH-ALLAFTLGVKQIVVGVNKMDTVKYSEDRYEEIKKEV (SEQ ID NO: 30), (b) an amino acid sequence which comprises at least 55 contiguous amino acid residues of the sequence DYLKKVGYQADKVDFIPISGFEGDNLIEKS-DKTPWYKGRTLIEALDTMEPPKRPYDKPL-RIPLQGVYKIGGIGTVPVGRVETGILKAGMVLN-FAPSAVVSECKSVEMHKEVLEEARPGDNIGFNVKN-VSVKEIKRGYVASDTKNEPAKGCSKFTAQVIIL-NHPGEIKNGY (SEQ ID NO: 31), (c) the amino acid sequence of HISCKFLNIDSKIDKRSGKVVEENPK (SEQ ID NO: 32), or (d) an amino acid sequence which comprises at least 20 contiguous amino acid residues of the sequence LEPKKPMVVETFTEYPPLGRFAIRDMRQTIAVGIIK (SEQ ID NO: 33).

When the composition comprises an isolated polypeptide comprising at least 40 contiguous amino acid residues (e.g., 40, 45, 50, 55, 60, 65, 70, 75, 80, 85, 90, 95, 100, 105, 110, 115, 120, 125, 130, 135, 140, 145, 150 155, 160, 165, 170, or 172 contiguous amino acid residues) of SEQ ID NO: 30, the isolated polypeptide can comprise, for example, SEQ ID NO: 30. When the composition comprises an isolated polypeptide comprising at least 55 contiguous amino acid residues (e.g., 55, 60, 65, 70, 75, 80, 85, 90, 95, 100, 105, 110, 115, 120, 125, 130, 135, 140, 145, 150 155, 160, 165, or 170 contiguous amino acid residues) of SEQ ID NO: 31, the isolated polypeptide can comprise, for example, SEQ ID NO: 31. When the composition comprises an isolated polypeptide comprising at least 20 contiguous amino acid residues (e.g., 20, 21, 22, 23, 24, 25, 26, 27, 28, 29, 30, 31, 32 or 33 contiguous amino acid residues) of SEQ ID NO: 33, the isolated polypeptide can comprise, for example, SEQ ID NO: 33.

The composition can comprise one, two, three or all four of the aforementioned polypeptides alone or in any combination. In this respect, the composition can comprise any combination of any two of the aforementioned sequences, any combination of any three of the aforementioned sequences, or all four of the aforementioned sequences. In a preferred embodiment, the composition comprises an isolated polypeptide comprising the amino acid sequence of SEQ ID NO: 34, SEQ ID NO: 35, or SEQ ID NO: 36.

In another embodiment, the composition comprises a pharmaceutically acceptable carrier and one or more isolated polypeptides, wherein each of the one or more isolated polypeptides comprises (a) the amino acid sequence of GKVAIILXGKHMGKRCIITK (SEQ ID NO: 40), wherein X is a threonine (T) residue or a serine (S) residue, (b) the amino acid sequence of GKHMGKRCIITKXLXSGLLAV-VGPYE (SEQ ID NO: 41), wherein X is an isoleucine (I) residue, a valine (V) residue, an asparagine (N) residue, or a threonine (T) residue, (c) the amino acid sequence of SGLLAVVGPYEXNGVPLKRV (SEQ ID NO: 42), wherein X is a valine (V) residue or an isoleucine (I) residue.

When the composition comprises an isolated polypeptide comprising the amino acid sequence of GKVAIILXG-KHMGKRCIITK (SEQ ID NO: 40), X can be any suitable amino acid residue, but preferably is a threonine (T) residue or a serine (S) residue. In this respect, the isolated polypeptide can comprise, for example, the amino acid sequence of GKVAIILTGKHMGKRCIITK (SEQ ID NO: 43) or GKVAIILSGKHMGKRCIITK (SEQ ID NO: 44). When the composition comprises an isolated polypeptide comprising the amino acid sequence of GKHMGKRCIITKXLXSGL-LAVVGPYE (SEQ ID NO: 41), X can be any suitable amino acid residue, but preferably is an isoleucine (I) residue, a valine (V) residue, an asparagine (N) residue, or a threonine (T) residue. In this respect, the isolated polypeptide can comprise, for example, the amino acid sequence of GKHMGKRCIITKILNSGLLAVVGPYE (SEQ ID NO: 45) or GKHMGKRCIITKVLTSGLLAVVGPYE (SEQ ID NO: 46). When the composition comprises an isolated polypeptide comprising the amino acid sequence of SGLLAVVG-PYEXNGVPLKRV (SEQ ID NO: 42), X can be any suitable amino acid residue, but preferably is a valine (V) residue or an isoleucine (I) residue. In this respect, the isolated polypeptide can comprise, for example, the amino acid sequence of SGLLAVVGPYEVNGVPLKRV (SEQ ID NO: 47) or SGLLAVVGPYEINGVPLKRV (SEQ ID NO: 48).

The composition can comprise one, two, or all three of the aforementioned polypeptides alone or in any combination. In this respect, the composition can comprise any combination of any two of the aforementioned sequences, or all three of the aforementioned sequences. In a preferred embodiment, the composition comprises an isolated polypeptide comprising the amino acid sequence of SEQ ID NO: 49, SEQ ID NO: 50, or SEQ ID NO: 51.

In another embodiment, the composition comprises a pharmaceutically acceptable carrier and one or more isolated polypeptides, wherein each of the one or more isolated polypeptides comprises (a) an amino acid sequence comprising at least 20 contiguous amino acid residues of the sequence LEKKMQLKKEGKLLSAKAKEEKKK (SEQ ID NO: 55), (b) an amino acid sequence comprising at least 21 contiguous amino acid residues of the sequence IVCIL-GHVDTGKTKLLDKLRHTNVQDNEAGGITQQI-GATFFPKD (SEQ ID NO: 56), (c) an amino acid sequence comprising at least 21 contiguous amino acid residues of the sequence the amino acid sequence of SKGIMIIDTPGHES-FYNLRKRGSSLCDIAILVIDLMHGLEQQTKESIQ-ILKQRNCPFVIALNKIDRLYMW (SEQ ID NO: 57), (d) an amino acid sequence comprising at least 20 contiguous amino acid residues of the sequence KLECTV-LEVKNIEGLGTTIDVILTNG (SEQ ID NO: 58), (e) the amino acid sequence of GVGLYVMASTLGSLEALLIFL (SEQ ID NO: 59), and (f) an amino acid sequence comprising at least 20 contiguous amino acid residues of the sequence MTDVSDVFNHVDKXGVGLYVMAS-TLGSLEALLIFL (SEQ ID NO: 60), wherein X is a serine (S) residue or a threonine (T) residue.

When the composition comprises an isolated polypeptide comprising at least 20 contiguous amino acid residues (e.g., 20, 21, 22, 23, or 24 contiguous amino acid residues) of SEQ ID NO: 55, the isolated polypeptide can comprise, for example, SEQ ID NO: 55. When the composition comprises an isolated polypeptide comprising an amino acid sequence comprising at least 21 contiguous amino acid residues (22, 23, 24 25, 26, 27, 28, 29, 30, 31, 32, 33, 34, 35, 36, 37, 38, 39, 40, 41, 42, 43, or 44 contiguous amino acid residues) of SEQ ID NO: 56, the isolated polypeptide can comprise, for example, SEQ ID NO: 56. When the composition comprises an isolated polypeptide comprising at least 21 contiguous amino acid residues (e.g., 21, 25, 30, 35, 40, 45, 50, 55, 60, 65, or 70 contiguous amino acid residues) of SEQ ID NO: 57, the isolated polypeptide can comprise, for example, SEQ ID NO: 57. When the composition comprises an isolated polypeptide comprising at least 20 contiguous amino acid residues (e.g., 20, 21, 22, 23, 24, 25, or 26 contiguous amino acid sequences) of SEQ ID NO: 58, the isolated polypeptide can comprise, for example, SEQ ID NO: 58. When the composition comprises an isolated polypeptide comprising at least 20 contiguous amino acid residues (e.g., 20, 21, 22, 23, 24 25, 26, 27, 28, 29, 30, 31, 32, 33, 34, or 35 contiguous amino acid residues) of SEQ ID NO: 60, X can be any suitable amino acid residue, but preferably is a serine (S)

residue or a threonine (T) residue. In this respect, the isolated polypeptide can comprise, for example, an isolated polypeptide comprising at least 20 contiguous amino acid residues of the sequence MTDVSDVFNHVDKSGVGLYV-MASTLGSLEALLIFL (SEQ ID NO: 61) or MTDVSDVF-NHVDKTGVGLYVMASTLGSLEALLIFL (SEQ ID NO: 62). In particular, the isolated polypeptide can comprise, for example, the amino acid sequence of MTDVSDVFN-HVDKSGVGLYVMASTLGSLEALLIFL (SEQ ID NO: 61) or MTDVSDVFNHVDKTGVGLYVMASTLGSLEAL-LIFL (SEQ ID NO: 62).

The composition can comprise one, two, three, four, five, or all six of the aforementioned polypeptides alone or in any combination. In this respect, the composition can comprise any combination of any two of the aforementioned sequences, any combination of any three of the aforementioned sequences, any combination of any four of the aforementioned sequences, any combination of any five of the aforementioned sequences, or all six of the aforementioned sequences. In a preferred embodiment, the composition comprises an isolated polypeptide comprising the amino acid sequence of SEQ ID NO: 63, SEQ ID NO: 64, or SEQ ID NO: 65.

In another embodiment, the composition comprises a pharmaceutically acceptable carrier and one or more isolated polypeptides, wherein each of the one or more isolated polypeptides comprises (a) the amino acid sequence of NLFFAKQVIPNACATQAILSI (SEQ ID NO: 69), and (b) the amino acid sequence of NFDSXMKGLTLSNCXFL-RNIHN (SEQ ID NO: 70), wherein X is a serine (S) residue, a threonine (T) residue, or an asparagine (N) residue.

When the composition comprises the amino acid sequence of SEQ ID NO: 70, X can be any suitable amino acid residue, but preferably is a serine (S) residue, a threonine (T) residue, or an asparagine (N) residue. In this respect, the isolated polypeptide can comprise, for example, the amino acid sequence of NFDSTMKGLTLSNCNFL-RNIHN (SEQ ID NO: 71), NFDSSMKGLTLSNCTFL-RNIHN (SEQ ID NO: 72), or NFDSSMKGLTLSNCNFL-RNIHN (SEQ ID NO: 73). The composition can comprise one or both of the aforementioned polypeptides. In a preferred embodiment, the composition comprises an isolated polypeptide comprising the amino acid sequence of SEQ ID NO: 74, SEQ ID NO: 75, or SEQ ID NO: 76.

In another embodiment, the composition comprises a pharmaceutically acceptable carrier and one or more isolated polypeptides, wherein each of the one or more isolated polypeptides comprises (a) the amino acid sequence of SGWKFEEQEGDVNMVLTKNVD (SEQ ID NO: 80), (b) an amino acid sequence comprising at least 20 contiguous amino acid residues of the sequence IIDFQLVSPFQAEGE-NEAQAEMTDFSVTVEKPN (SEQ ID NO: 81), (c) an amino acid sequence comprising at least 20 contiguous amino acid residues of the sequence GGITFYCT-TLQNDEKFRYMIGNVKYYKNEEGKNSVS (SEQ ID NO: 82), and (d) an amino acid sequence comprising at least 21 contiguous amino acid residues of the sequence YNGPE-FEDLDDSLQTSLDEWLANLGVDSELCDFIDSCSID-KEQREYM (SEQ ID NO: 83).

When the composition comprises an isolated polypeptide comprising at least 20 contiguous amino acid residues (e.g., 20, 21, 22, 23, 24 25, 26, 27, 28, 29, 30, 31, 32, or 33 contiguous amino acid residues) of SEQ ID NO: 81, the isolated polypeptide can comprise, for example, SEQ ID NO: 81. When the composition comprises an isolated polypeptide comprising at least 20 contiguous amino acid residues (e.g., 20, 21, 22, 23, 24 25, 26, 27, 28, 29, 30, 31, 32, 33, 34, 35 or 36 contiguous amino acid residues) of SEQ ID NO: 82, the isolated polypeptide can comprise, for example, SEQ ID NO: 82. When the composition comprises an isolated polypeptide comprising at least 21 contiguous amino acid residues of SEQ ID NO: 83, (e.g., 21, 22, 23, 24 25, 26, 27, 28, 29, 30, 31, 32, 33, 34, 35, 36, 37, 38, 39, 40, 41, 42, 43, 44, 45, 46, or 47 contiguous amino acid residues), the isolated polypeptide can comprise, for example, SEQ ID NO: 83.

The composition can comprise one, two, or all three of the aforementioned polypeptides alone or in any combination. In this respect, the composition can comprise any combination of any two of the aforementioned sequences, or all three of the aforementioned sequences. In a preferred embodiment, the composition comprises an isolated polypeptide comprising the amino acid sequence of SEQ ID NO: 84, SEQ ID NO: 85, or SEQ ID NO: 86.

In another embodiment, the composition comprises a pharmaceutically acceptable carrier and one or more isolated polypeptides, each of which comprises the amino acid sequence of SEQ ID NO: 90, SEQ ID NO: 91, SEQ ID NO: 92, SEQ ID NO: 93, or SEQ ID NO: 202. The invention also provides a composition comprising a pharmaceutically acceptable carrier and one or more isolated polypeptides, each of which comprises the amino acid sequence of SEQ ID NO: 98, SEQ ID NO: 99, or SEQ ID NO: 100.

In another embodiment, the composition comprises a pharmaceutically acceptable carrier and one or more isolated polypeptides, wherein each of the one or more isolated polypeptides comprises (a) the amino acid sequence of LLKHGWCEMLKGGVIMDVKX (SEQ ID NO: 104), wherein X is an asparagine (N) residue or a serine (S) residue, (b) an amino acid sequence comprising at least 20 contiguous amino acid residues of the sequence VEQAKI-AEXAGAIGVMVLENIPSELR (SEQ ID NO: 105), wherein X is a lysine (K) residue or a glutamic acid (E) residue, (c) an amino acid sequence comprising at least 20 contiguous amino acid residues of the sequence SINVLAK-VRIGHFVEAQILEELK (SEQ ID NO: 106), (d) an amino acid sequence comprising at least 27 contiguous amino acid residues of the sequence KHKFKTPFVCGCTNLGEALR-RXSEGASMIRTKGEAGTGNII (SEQ ID NO: 107), wherein X is an isoleucine (I) residue or a methionine (M) residue, (e) an amino acid sequence comprising at least 20 contiguous amino acid residues of the sequence ATPADAAMCMQLGMDGVFVGSGIFESENP (SEQ ID NO: 108), or (f) an amino acid sequence comprising at least 20 contiguous amino acid residues of the sequence LPV-VNFAAGGXATPADAAMCMQLGMDGVFVGS-GIFESENP (SEQ ID NO: 109), wherein X is an isoleucine (I) residue or a valine (V) residue.

When the composition comprises an isolated polypeptide comprising the amino acid sequence of LLKHGWCEMLK-GGVIMDVKX (SEQ ID NO: 104), X can be any suitable amino acid residue, but preferably is an asparagine (N) residue or a serine (S) residue. In this respect, the isolated polypeptide can comprise, for example, the amino acid sequence of LLKHGWCEMLKGGVIMDVKN (SEQ ID NO: 110), or LLKHGWCEMLKGGVIMDVKS (SEQ ID NO: 111). When the composition comprises an isolated polypeptide comprising at least 20 contiguous amino acid residues (e.g., 20, 21, 22, 23, 24, 25, or 26 contiguous amino acid residues) of SEQ ID NO: 105, X can be any suitable amino acid residue, but preferably is a lysine (K) residue or a glutamic acid (E) residue. In this respect, the isolated polypeptide can comprise, for example, at least 20 contiguous amino acid residues of the sequence VEQAKIAEKA- GAIGVMVLENIPSELR (SEQ ID NO: 112), or VEQAKI-AEEAGAIGVMVLENIPSELR (SEQ ID NO: 113). In particular, the isolated polypeptide can comprise, for example, the amino acid sequence of VEQAKIAEKA-GAIGVMVLENIPSELR (SEQ ID NO: 112), or VEQAKI-AEEAGAIGVMVLENIPSELR (SEQ ID NO: 113). When the composition comprises an isolated polypeptide comprising at least 20 contiguous amino acid residues (e.g., 20, 21, 22, or 23 contiguous amino acid residues) of SEQ ID NO: 106, the isolated polypeptide can comprise, for example, SEQ ID NO: 106. When the composition comprises an isolated polypeptide comprising at least 27 contiguous amino acid residues (e.g., 27, 28, 29, 30, 31, 32, 33, 34, 35, 36, 37, 38, 39, 40, or 41 contiguous amino acid residues) of SEQ ID NO: 107, X can be any suitable amino acid residue, but preferably is an isoleucine (I) residue or a methionine (M) residue. In this respect, the isolated polypeptide can comprise, for example, at least 27 contiguous amino acid residues of KHKFKTPFVCGCTNLGEALRRISEGAS-MIRTKGEAGTGNII (SEQ ID NO: 207), or KHKFKTP-FVCGCTNLGEALRRMSEGASMIRTKGEAGTGNII (SEQ ID NO: 208). In particular, the isolated polypeptide can comprise, for example, the amino acid sequence of KHKFKTPFVCGCTNLGEALRRISEGASMIRTK-GEAGTGNII (SEQ ID NO: 207), or KHKFKTP-FVCGCTNLGEALRRMSEGASMIRTKGEAGTGNII (SEQ ID NO: 208). When the composition comprises an isolated polypeptide comprising at least 20 contiguous amino acid residues (e.g., 20, 21, 22, 23, 24, 25, 26, 27, 28, or 29 contiguous amino acid residues) of SEQ ID NO: 108, the isolated polypeptide can comprise, for example SEQ ID NO: 108. When the composition comprises an isolated polypeptide comprising least 20 contiguous amino acid residues (e.g., 20, 21, 22, 23, 24, 25, 26, 27, 28, 29, 30, 31, 32, 33, 34, 35, 36, 37, 38, 39, or 40 contiguous amino acid residues) of SEQ ID NO: 109, X can be any suitable amino acid residue, but preferably is an isoleucine (I) residue or a valine (V) residue. In this respect, the isolated polypeptide can comprise, for example, at least 20 contiguous amino acid residues of LPVVNFAAGGIATPADAAMCMQLGM-DGVFVGSGIFESENP (SEQ ID NO: 114), or LPVVN-FAAGGVATPADAAMCMQLGMDGVFVGSGIFESENP (SEQ ID NO: 115). In particular, the isolated polypeptide can comprise, for example, LPVVNFAAGGIATPADAAM-CMQLGMDGVFVGSGIFESENP (SEQ ID NO: 114), or LPVVNFAAGGVATPADAAMCMQLGMDGVFVGS-GIFESENP (SEQ ID NO: 115).

The composition can comprise one, two, three, four, five, or all six of the aforementioned polypeptides alone or in any combination. In this respect, the composition can comprise any combination of any two of the aforementioned sequences, any three of the aforementioned sequences, any four of the aforementioned sequences, any five of the aforementioned sequences, or all six of the aforementioned sequences. In a preferred embodiment, the composition comprises an isolated polypeptide comprising the amino acid sequence of SEQ ID NO: 116, SEQ ID NO: 117, SEQ ID NO: 118, or SEQ ID NO: 205.

The polypeptides of the inventive composition can be prepared by any method, such as by synthesizing the polypeptide or by expressing a nucleic acid encoding an appropriate amino acid sequence in a cell and harvesting the peptide from the cell or media containing the cell. A combination of such methods also can be used. Methods of de novo synthesizing polypeptides and methods of recombinantly producing polypeptides are known in the art (see, e.g., Chan et al., *Fmoc Solid Phase Peptide Synthesis*, Oxford University Press, Oxford, United Kingdom (2005); Reid, R. (ed.), *Peptide and Protein Drug Analysis*, Marcel Dekker, Inc. (2000); Westwood et al. (ed.), *Epitope Mapping*, Oxford University Press, Oxford, United Kingdom (2000); Sambrook et al., *Molecular Cloning: A Laboratory Manual*, 3$^{rd}$ ed., Cold Spring Harbor Press, Cold Spring Harbor, N.Y. (2001); and Ausubel et al., *Current Protocols in Molecular Biology*, Greene Publishing Associates and John Wiley & Sons, New York (1994)).

In another embodiment of the invention, the composition can comprise a pharmaceutically acceptable carrier and one or more isolated nucleic acid sequences, each of which encodes any of the aforementioned isolated polypeptides. In this respect, the composition can comprise one or more isolated nucleic acid sequences, wherein each of the one or more nucleic acid sequences encodes a polypeptide comprising the amino acid sequence of any one of SEQ ID NO: 1-SEQ ID NO: 16, SEQ ID NO: 20-SEQ ID NO: 26, SEQ ID NO: 30-SEQ ID NO: 36, SEQ ID NO: 40-SEQ ID NO: 51, SEQ ID NO: 55-SEQ ID NO: 65, SEQ ID NO: 69-SEQ ID NO: 76, SEQ ID NO: 80-SEQ ID NO: 86, SEQ ID NO: 90-SEQ ID NO: 93, SEQ ID NO: 98-SEQ ID NO: 100, SEQ ID NO: 104-SEQ ID NO: 118, SEQ ID NO: 202, SEQ ID NO: 205, SEQ ID NO: 207-SEQ ID NO: 209, SEQ ID NO: 211, or SEQ ID NO: 212.

In one embodiment, the one or more isolated nucleic acid sequences comprise codons expressed more frequently (and preferably, most frequently) in humans than in *Plasmodium*. While the genetic code is generally universal across species, the choice among synonymous codons is often species-dependent. One of ordinary skill in the art would appreciate that, to achieve maximum protection against *Plasmodium* infection, high levels of *Plasmodium* antigens must be expressed in a mammalian, preferably a human, host. In this respect, the nucleic acid sequence preferably encodes the native amino acid sequence of a *Plasmodium* antigen, but comprises codons that are expressed more frequently in mammals (e.g., humans) than in *Plasmodium*. Changing native *Plasmodium* codons to the most frequently used in mammals will increase expression of the *Plasmodium* antigen in a mammal (e.g., a human). Such modified nucleic acid sequences are commonly described in the art as "humanized," as "codon-optimized," or as utilizing "mammalian-preferred" or "human-preferred" codons In the context of the invention, a *Plasmodium* nucleic acid sequence is said to be "codon-optimized" if at least about 60% (e.g., at least about 70%, at least about 80%, or at least about 90%) of the wild-type codons in the nucleic acid sequence are encoded by mammalian-preferred codons. That is, a *Plasmodium* nucleic acid sequence is codon-optimized if at least about 60% of the codons in the nucleic acid sequence are mammalian-preferred codons.

Alternatively, the one or more isolated nucleic acid sequences can utilize particular codons at frequencies that best approximate codon usage frequencies of native *Plasmodium* species. Methods and algorithms have been developed in order to facilitate and adjust codon usage in this manner when expressing genes in heterologous systems, and these methods are referred to as "codon harmonization" (see, e.g., U.S. Patent Application Publication 2004/0209323; Angov et al., *PLoS ONE*, 3(5): e2189 (2008); and Angov et al., *Methods Mol. Biol.*, 705: 1-13 (2011)). Adjusting codons of the isolated nucleic acid sequence so as to mimic the codon usage of a native *Plasmodium* gene may improve gene and/or protein expression by, for example, improving protein folding or protein solubility. Such modified nucleic acid sequences are commonly described in the art as "harmonized" or "codon-harmonized."

Additionally and alternatively, the codon-optimized or codon-harmonized nucleic acid sequence encoding a *Plasmodium* antigen can be any sequence that hybridizes to an above-described sequence under at least moderate, preferably high, stringency conditions, such as described in, e.g., Sambrook et al., *Molecular Cloning, a Laboratory Manual*, 3rd edition, Cold Spring Harbor Press, Cold Spring Harbor, N.Y. (2001). Determining the degree of homology can be accomplished using any suitable method known in the art, such as those described herein.

In a preferred embodiment, the composition can comprise any one, or combination of, the following nucleic acid sequences: SEQ ID NO: 17, SEQ ID NO: 18, SEQ ID NO: 19, SEQ ID NO: 27, SEQ ID NO: 28, SEQ ID NO: 29, SEQ ID NO: 37, SEQ ID NO: 38, SEQ ID NO: 39, SEQ ID NO: 52, SEQ ID NO: 53, SEQ ID NO: 54, SEQ ID NO: 66, SEQ ID NO: 67, SEQ ID NO: 68, SEQ ID NO: 77, SEQ ID NO: 78, SEQ ID NO: 79, SEQ ID NO: 87, SEQ ID NO: 88, SEQ ID NO: 89, SEQ ID NO: 94, SEQ ID NO: 95, SEQ ID NO: 96, SEQ ID NO: 97, SEQ ID NO: 101, SEQ ID NO: 102, SEQ ID NO: 103, SEQ ID NO: 119, SEQ ID NO: 120, SEQ ID NO: 121, SEQ ID NO: 203, SEQ ID NO: 204, SEQ ID NO: 206, or SEQ ID NO: 210.

In one embodiment of the invention, the one or more isolated nucleic acid sequences which encode the *Plasmodium* antigens are present in a vector. Any vector can be employed in the context of the invention, including viral and non-viral vectors. Examples of suitable viral vectors include, but are not limited to, retroviral vectors, adeno-associated virus vectors, poxviral vectors (e.g., vaccinia virus vectors), herpesvirus vectors, parainfluenza-RSV chimeric vectors (PIV-RSV), adenoviral vectors, poliovirus, alphavirus, baculovirus, and Sindbis virus. Examples of suitable non-viral vectors include, but are not limited to, plasmids (e.g., DNA plasmids), yeast (e.g., *Saccharomyces*), liposomes, nanoparticles, and molecular conjugates (e.g., transferrin). When the vector is a plasmid (e.g., DNA plasmid), the plasmid can be administered with adjuvants, such as CpG or polymeric adjuvants. The vector also can be a virus-like particle (VLP) (see, e.g., Petry et al., *Curr. Opin. Molecular Therapeutics*, 5(5): 524-528 (2003); and U.S. Pat. No. 5,298,244).

In a preferred embodiment, the vector is an adenoviral vector. The term "adenoviral vector," as used herein, refers to an adenovirus in which the adenoviral genome has been manipulated to accommodate one or more nucleic acid sequences that are non-native with respect to the adenoviral genome. Typically, an adenoviral vector is generated by introducing one or more mutations (e.g., a deletion, insertion, or substitution) into the adenoviral genome of the adenovirus so as to accommodate the insertion of a non-native nucleic acid sequence, for example, for gene transfer, into the adenovirus.

Non-human adenovirus (e.g., ape, simian, avian, canine, ovine, or bovine adenoviruses) can be used to generate the adenoviral vector (i.e., as a source of the adenoviral genome for the adenoviral vector). For example, the adenoviral vector can be based on a simian adenovirus, including both new world and old world monkeys (see, e.g., *Virus Taxonomy: VIIIth Report of the International Committee on Taxonomy of Viruses* (2005)). A phylogeny analysis of adenoviruses that infect primates is disclosed in, e.g., Roy et al., *PLoS Pathog.*, 5(7): e100050. doi:10.1371/journal.ppat.1000503 (2009). For instance, a simian adenovirus can be of genotype 1, 3, 6, 7, 11, 16, 18, 19, 20, 27, 33, 38, 39, 48, 49, or 50, or any other simian adenoviral genotype. Other non-human adenoviruses which can be used in the invention include non-human primate adenoviruses that are genetically and/or phenotypically similar to or distinct from group C human adenoviruses.

A gorilla adenovirus can be used as the source of the adenoviral genome for the adenoviral vector. There are four widely recognized gorilla subspecies within the two species of Eastern Gorilla (*Gorilla beringei*) and Western Gorilla (*Gorilla gorilla*). The Western Gorilla species includes the subspecies Western Lowland Gorilla (*Gorilla gorilla gorilla*) and Cross River Gorilla (*Gorilla gorilla diehli*). The Eastern Gorilla species includes the subspecies Mountain Gorilla (*Gorilla beringei beringei*) and Eastern Lowland Gorilla (*Gorilla beringei graueri*) (see, e.g., Wilson and Reeder, eds., *Mammalian Species of the World*, 3rd ed., Johns Hopkins University Press, Baltimore, Md. (2005)). The adenoviral vector can be based on an adenovirus isolated from any of the aforementioned subspecies. Preferably, the adenoviral vector is based on an adenovirus isolated from Mountain Gorilla (*Gorilla beringei beringei*) or Eastern Lowland Gorilla (*Gorilla beringei graueri*). Gorilla adenoviruses and adenoviral vectors are described in, e.g., International Patent Application Nos. PCT/US2012/058956, PCT/US2012/058978, and PCT/US2012/059006.

A human adenovirus can be used as the source of the adenoviral genome for the adenoviral vector. For instance, an adenovirus can be of subgroup A (e.g., serotypes 12, 18, and 31), subgroup B (e.g., serotypes 3, 7, 11, 14, 16, 21, 34, 35, and 50), subgroup C (e.g., serotypes 1, 2, 5, and 6), subgroup D (e.g., serotypes 8, 9, 10, 13, 15, 17, 19, 20, 22-30, 32, 33, 36-39, and 42-48), subgroup E (e.g., serotype 4), subgroup F (e.g., serotypes 40 and 41), an unclassified serogroup (e.g., serotypes 49 and 51), or any other adenoviral serogroup or serotype. Adenoviral serotypes 1 through 51 (i.e., Ad1 through Ad51) are available from the American Type Culture Collection (ATCC, Manassas, Va.). Non-group C adenoviral vectors, methods of producing non-group C adenoviral vectors, and methods of using non-group C adenoviral vectors are disclosed in, for example, U.S. Pat. Nos. 5,801,030, 5,837,511, and 5,849,561, and International Patent Application Publications WO 1997/012986 and WO 1998/053087.

The adenoviral vector can comprise a combination of subtypes and thereby be a "chimeric" adenoviral vector. A chimeric adenoviral vector can comprise an adenoviral genome that is derived from two or more (e.g., 2, 3, 4, etc.) different adenovirus serotypes. In the context of the invention, a chimeric adenoviral vector can comprise approximately different or equal amounts of the genome of each of the two or more different adenovirus serotypes. For example, when the chimeric adenoviral vector genome is comprised of the genomes of two different adenovirus serotypes, the chimeric adenoviral vector genome preferably comprises no more than about 99.9% (e.g., no more than about 99%, no more than about 98%, no more than about 95%, no more than about 85%, no more than about 80%, no more than about 75%, no more than about 60%, no more than about 65%, or no more than about 50%) of the genome of one of the adenovirus serotypes, with the remainder of the chimeric adenovirus genome being derived from the genome of the other adenovirus serotype.

The adenoviral vector can be replication-competent, conditionally replication-competent, or replication-deficient.

A replication-competent adenoviral vector can replicate in typical host cells, i.e., cells typically capable of being infected by an adenovirus. A replication-competent adenoviral vector can have one or more mutations as compared to a wild-type adenovirus (e.g., one or more deletions, insertions, and/or substitutions) in the adenoviral genome that do not inhibit viral replication in host cells. For example, the adenoviral vector can have a partial or entire deletion of the adenoviral early region known as the E3 region, which is not essential for propagation of the adenoviral vector genome.

A conditionally-replicating adenoviral vector is an adenoviral vector that has been engineered to replicate under pre-determined conditions. For example, replication-essential gene functions, e.g., gene functions encoded by the adenoviral early regions, can be operably linked to an inducible, repressible, or tissue-specific transcription control sequence, e.g., a promoter. In such an embodiment, replication requires the presence or absence of specific factors that interact with the transcription control sequence. Conditionally-replicating adenoviral vectors are further described in U.S. Pat. No. 5,998,205.

A replication-deficient adenoviral vector is an adenoviral vector that requires complementation of one or more gene functions or regions of the adenoviral genome that are required for replication, as a result of, for example, a deficiency in one or more replication-essential gene function or regions, such that the adenoviral vector does not replicate in typical host cells, especially those in a human to be infected by the adenoviral vector.

A deficiency in a gene function or genomic region, as used herein, is defined as a disruption (e.g., deletion) of sufficient genetic material of the adenoviral genome to obliterate or impair the function of the gene (e.g., such that the function of the gene product is reduced by at least about 2-fold, 5-fold, 10-fold, 20-fold, 30-fold, or 50-fold) whose nucleic acid sequence was disrupted (e.g., deleted) in whole or in part. Deletion of an entire gene region often is not required for disruption of a replication-essential gene function. However, for the purpose of providing sufficient space in the adenoviral genome for one or more transgenes, removal of a majority of one or more gene regions may be desirable. While deletion of genetic material is preferred, mutation of genetic material by addition or substitution also is appropriate for disrupting gene function. Replication-essential gene functions are those gene functions that are required for adenovirus replication (e.g., propagation) and are encoded by, for example, the adenoviral early regions (e.g., the E1, E2, and E4 regions), late regions (e.g., the L1, L2, L3, L4, and L5 regions), genes involved in viral packaging (e.g., the IVa2 gene), and virus-associated RNAs (e.g., VA-RNA-1 and/or VA-RNA-2).

Whether the adenoviral vector is replication-competent or replication-deficient, the adenoviral vector retains at least a portion of the adenoviral genome. The adenoviral vector can comprise any portion of the adenoviral genome, including protein coding and non-protein coding regions. Desirably, the adenoviral vector comprises at least one nucleic acid sequence that encodes an adenovirus protein. The adenoviral vector can comprise a nucleic acid sequence that encodes any suitable adenovirus protein, such as, for example, a protein encoded by any one of the early region genes (i.e., E1A, E1B, E2A, E2B, E3, and/or E4 regions), or a protein encoded by any one of the late region genes, which encode the virus structural proteins (i.e., L1, L2, L3, L4, and L5 regions).

Preferably, the adenoviral vector is replication-deficient, such that the replication-deficient adenoviral vector requires complementation of at least one replication-essential gene function of one or more regions of the adenoviral genome for propagation (e.g., to form adenoviral vector particles).

The replication-deficient adenoviral vector can be modified in any suitable manner to cause the deficiencies in the one or more replication-essential gene functions in one or more regions of the adenoviral genome for propagation. The complementation of the deficiencies in the one or more replication-essential gene functions of one or more regions of the adenoviral genome refers to the use of exogenous means to provide the deficient replication-essential gene functions. Such complementation can be effected in any suitable manner, for example, by using complementing cells and/or exogenous DNA (e.g., helper adenovirus) encoding the disrupted replication-essential gene functions.

The adenoviral vector can be deficient in one or more replication-essential gene functions of only the early regions (i.e., E1-E4 regions) of the adenoviral genome, only the late regions (i.e., L1-L5 regions) of the adenoviral genome, both the early and late regions of the adenoviral genome, or all adenoviral genes (i.e., a high capacity adenovector (HC-Ad)). See Morsy et al., Proc. Natl. Acad. Sci. USA, 95: 965-976 (1998); Chen et al., Proc. Natl. Acad. Sci. USA, 94: 1645-1650 (1997); and Kochanek et al., Hum. Gene Ther., 10: 2451-2459 (1999). Examples of replication-deficient adenoviral vectors are disclosed in U.S. Pat. Nos. 5,837,511; 5,851,806; 5,994,106; 6,127,175; 6,482,616; and 7,195,896, and International Patent Application Publications WO 1994/028152, WO 1995/002697, WO 1995/016772, WO 1995/034671, WO 1996/022378, WO 1997/012986, WO 1997/021826, and WO 2003/022311.

The early regions of the adenoviral genome include the E1, E2, E3, and E4 regions. The E1 region comprises the E1A and E1B subregions, and one or more deficiencies in replication-essential gene functions in the E1 region can include one or more deficiencies in replication-essential gene functions in either or both of the E1A and E1B subregions, thereby requiring complementation of the E1A subregion and/or the E1B subregion of the adenoviral genome for the adenoviral vector to propagate (e.g., to form adenoviral vector particles). The E2 region comprises the E2A and E2B subregions, and one or more deficiencies in replication-essential gene functions in the E2 region can include one or more deficiencies in replication-essential gene functions in either or both of the E2A and E2B subregions, thereby requiring complementation of the E2A subregion and/or the E2B subregion of the adenoviral genome for the adenoviral vector to propagate (e.g., to form adenoviral vector particles).

The E3 region does not include any replication-essential gene functions, such that a deletion of the E3 region in part or in whole does not require complementation of any gene functions in the E3 region for the adenoviral vector to propagate (e.g., to form adenoviral vector particles). In the context of the invention, the E3 region is defined as the region that initiates with the open reading frame that encodes a protein with high homology to the 12.5K protein from the E3 region of human adenovirus 5 (NCBI reference sequence AP_000218) and ends with the open reading frame that encodes a protein with high homology to the 14.7K protein from the E3 region of human adenovirus 5 (NCBI reference sequence AP_000224.1). The E3 region may be deleted in whole or in part, or retained in whole or in part. The size of the deletion may be tailored so as to retain an adenoviral vector whose genome closely matches the optimum genome packaging size. A larger deletion will accommodate the insertion of larger heterologous nucleic acid sequences in the adenoviral genome. In one embodiment of the invention, the L4 polyadenylation signal sequences, which reside in the E3 region, are retained.

The E4 region comprises multiple open reading frames (ORFs). An adenoviral vector with a deletion of all of the open reading frames of the E4 region except ORF6, and in some cases ORF3, does not require complementation of any gene functions in the E4 region for the adenoviral vector to propagate (e.g., to form adenoviral vector particles). Conversely, an adenoviral vector with a disruption or deletion of ORF6, and in some cases ORF3, of the E4 region (e.g., with a deficiency in a replication-essential gene function based in ORF6 and/or ORF3 of the E4 region), with or without a disruption or deletion of any of the other open reading frames of the E4 region or the native E4 promoter, polyadenylation sequence, and/or the right-side inverted terminal repeat (ITR), requires complementation of the E4 region (specifically, of ORF6 and/or ORF3 of the E4 region) for the adenoviral vector to propagate (e.g., to form adenoviral vector particles). The late regions of the adenoviral genome include the L1, L2, L3, L4, and L5 regions. The adenoviral vector also can have a mutation in the major late promoter (MLP), as discussed in International Patent Application Publication WO 2000/000628, which can render the adenoviral vector replication-deficient if desired.

The one or more regions of the adenoviral genome that contain one or more deficiencies in replication-essential gene functions desirably are one or more early regions of the adenoviral genome, i.e., the E1, E2, and/or E4 regions, optionally with the deletion in part or in whole of the E3 region.

The replication-deficient adenoviral vector also can have one or more mutations as compared to a wild-type adenovirus (e.g., one or more deletions, insertions, and/or substitutions) in the adenoviral genome that do not inhibit viral replication in host cells. Thus, in addition to one or more deficiencies in replication-essential gene functions, the adenoviral vector can be deficient in other respects that are not replication-essential. For example, the adenoviral vector can have a partial or entire deletion of the adenoviral early region known as the E3 region, which, as discussed herein, is not essential for propagation of the adenoviral genome.

In one embodiment, the adenoviral vector is replication-deficient and requires, at most, complementation of the E1 region or the E4 region of the adenoviral genome, for propagation (e.g., to form adenoviral vector particles). Thus, the replication-deficient adenoviral vector requires complementation of at least one replication-essential gene function of the E1A subregion and/or the E1B region of the adenoviral genome (denoted an E1-deficient adenoviral vector) or the E4 region of the adenoviral genome (denoted an E4-deficient adenoviral vector) for propagation (e.g., to form adenoviral vector particles). The adenoviral vector can be deficient in at least one replication-essential gene function (desirably all replication-essential gene functions) of the E1 region of the adenoviral genome and at least one gene function of the nonessential E3 region of the adenoviral genome (denoted an E1/E3-deficient adenoviral vector). The adenoviral vector can be deficient in at least one replication-essential gene function (desirably all replication-essential gene functions) of the E4 region of the adenoviral genome and at least one gene function of the nonessential E3 region of the adenoviral genome (denoted an E3/E4-deficient adenoviral vector).

In one embodiment, the adenoviral vector is replication-deficient and requires, at most, complementation of the E2 region, preferably the E2A subregion, of the adenoviral genome, for propagation (e.g., to form adenoviral vector particles). Thus, the replication-deficient adenoviral vector requires complementation of at least one replication-essential gene function of the E2A subregion of the adenoviral genome (denoted an E2A-deficient adenoviral vector) for propagation (e.g., to form adenoviral vector particles). The adenoviral vector can be deficient in at least one replication-essential gene function (desirably all replication-essential gene functions) of the E2A region of the adenoviral genome and at least one gene function of the nonessential E3 region of the adenoviral genome (denoted an E2A/E3-deficient adenoviral vector).

In one embodiment, the adenoviral vector is replication-deficient and requires, at most, complementation of the E1 and E4 regions of the adenoviral genome for propagation (e.g., to form adenoviral vector particles). Thus, the replication-deficient adenoviral vector requires complementation of at least one replication-essential gene function of both the E1 and E4 regions of the adenoviral genome (denoted an E1/E4-deficient adenoviral vector) for propagation (e.g., to form adenoviral vector particles). The adenoviral vector can be deficient in at least one replication-essential gene function (desirably all replication-essential gene functions) of the E1 region of the adenoviral genome, at least one replication-essential gene function of the E4 region of the adenoviral genome, and at least one gene function of the nonessential E3 region of the adenoviral genome (denoted an E1/E3/E4-deficient adenoviral vector). The adenoviral vector preferably requires, at most, complementation of the E1 region of the adenoviral genome for propagation, and does not require complementation of any other deficiency of the adenoviral genome for propagation. More preferably, the adenoviral vector requires, at most, complementation of the E1 and E4 regions of the adenoviral genome for propagation, and does not require complementation of any other deficiency of the adenoviral genome for propagation.

The adenoviral vector, when deficient in multiple replication-essential gene functions of the adenoviral genome (e.g., an E1/E4-deficient adenoviral vector), can include a spacer sequence to provide viral growth in a complementing cell line similar to that achieved by adenoviruses or adenoviral vectors deficient in a single replication-essential gene function (e.g., an E1-deficient adenoviral vector). The spacer sequence can contain any nucleotide sequence or sequences which are of a desired length, such as sequences at least about 15 base pairs (e.g., between about 15 nucleotides and about 12,000 nucleotides), preferably about 100 nucleotides to about 10,000 nucleotides, more preferably about 500 nucleotides to about 8,000 nucleotides, even more preferably about 1,500 nucleotides to about 6,000 nucleotides, and most preferably about 2,000 to about 3,000 nucleotides in length, or a range defined by any two of the foregoing values. The spacer sequence can be coding or non-coding and native or non-native with respect to the adenoviral genome, but does not restore the replication-essential function to the deficient region. The spacer also can contain an expression cassette. More preferably, the spacer comprises a polyadenylation sequence and/or a gene that is non-native with respect to the adenoviral vector. The use of a spacer in an adenoviral vector is further described in, for example, U.S. Pat. No. 5,851,806 and International Patent Application Publication WO 1997/021826.

By removing all or part of the adenoviral genome, for example, the E1, E3, and E4 regions of the adenoviral genome, the resulting adenoviral vector is able to accept inserts of exogenous nucleic acid sequences while retaining the ability to be packaged into adenoviral capsids. An exogenous nucleic acid sequence can be inserted at any position in the adenoviral genome so long as insertion in the position allows for the formation of the adenoviral vector particle. The exogenous nucleic acid sequence (i.e., a nucleic acid sequence encoding a *Plasmodium* antigen) preferably is positioned in the E1 region, the E3 region, or the E4 region of the adenoviral genome.

The replication-deficient adenoviral vector of the invention can be produced in complementing cell lines that provide gene functions not present in the replication-deficient adenoviral vector, but required for viral propagation, at appropriate levels in order to generate high titers of viral vector stock. Such complementing cell lines are known and include, but are not limited to, 293 cells (described in, e.g., Graham et al., *J. Gen. Virol.*, 36: 59-72 (1977)), PER.C6 cells (described in, e.g., International Patent Application Publication WO 1997/000326, and U.S. Pat. Nos. 5,994,128 and 6,033,908), and 293-ORF6 cells (described in, e.g., International Patent Application Publication WO 1995/034671 and Brough et al., *J Virol.*, 71: 9206-9213 (1997)). Other suitable complementing cell lines to produce the replication-deficient adenoviral vector of the invention include complementing cells that have been generated to propagate adenoviral vectors encoding transgenes whose expression inhibits viral growth in host cells (see, e.g., U.S. Patent Application Publication 2008/0233650). Additional suitable complementing cells are described in, for example, U.S. Pat. Nos. 6,677,156 and 6,682,929, and International Patent Application Publication WO 2003/020879. In some instances, the cellular genome need not comprise nucleic acid sequences, the gene products of which complement for all of the deficiencies of a replication-deficient adenoviral vector. One or more replication-essential gene functions lacking in a replication-deficient adenoviral vector can be supplied by a helper virus, e.g., an adenoviral vector that supplies in trans one or more essential gene functions required for replication of the replication-deficient adenoviral vector. Alternatively, the adenoviral vector can comprise a non-native replication-essential gene that complements for the one or more replication-essential gene functions lacking in the inventive replication-deficient adenoviral vector. For example, an E1/E4-deficient adenoviral vector can be engineered to contain a nucleic acid sequence encoding E4 ORF6 that is obtained or derived from a different adenovirus (e.g., an adenovirus of a different serotype than the inventive adenoviral vector, or an adenovirus of a different species than the inventive adenoviral vector).

In addition to the one or more nucleic acid sequences encoding *Plasmodium* antigens, the adenoviral vector preferably comprises expression control sequences, such as promoters, enhancers, polyadenylation signals, transcription terminators, internal ribosome entry sites (IRES), and the like, that provide for the expression of the nucleic acid sequence in a host cell. Exemplary expression control sequences are known in the art and are described in, for example, Goeddel, *Gene Expression Technology: Methods in Enzymology*, Vol. 185, Academic Press, San Diego, Calif. (1990). Ideally, the *Plasmodium* antigen-encoding nucleic acid sequence is operably linked to a promoter and a polyadenylation sequence. The promoter desirably is a constitutive or inducible promoter, preferably a constitutive promoter. A large number of promoters, including constitutive, inducible, and repressible promoters, from a variety of different sources are well known in the art. Representative sources of promoters include for example, virus, mammal, insect, plant, yeast, and bacteria, and suitable promoters from these sources are readily available, or can be made synthetically, based on sequences publicly available, for example, from depositories such as the ATCC as well as other commercial or individual sources. Promoters can be unidirectional (i.e., initiate transcription in one direction) or bi-directional (i.e., initiate transcription in either a 3' or 5' direction). Non-limiting examples of promoters include, for example, the T7 bacterial expression system, pBAD (araA) bacterial expression system, the cytomegalovirus (CMV) promoter (human or mouse), the β-actin promoter (human or chicken), the EF1-α promoter, the ubiquitin promoter, the SV40 promoter, and the Rous Sarcoma Virus promoter. Inducible promoters include, for example, the Tet system (U.S. Pat. Nos. 5,464,758 and 5,814,618), the Ecdysone inducible system (No et al., *Proc. Natl. Acad. Sci.*, 93: 3346-3351 (1996)), the T-REx™ system (Invitrogen, Carlsbad, Calif.), LACSWITCH™ system (Stratagene, San Diego, Calif.), and the Cre-ERT tamoxifen inducible recombinase system (Indra et al., *Nuc. Acid. Res.*, 27: 4324-4327 (1999); *Nuc. Acid. Res.*, 28: e99 (2000); U.S. Pat. No. 7,112,715; and Kramer & Fussenegger, *Methods Mol. Biol.*, 308: 123-144 (2005)).

A promoter can be selected by matching its particular pattern of activity with the desired pattern and level of expression of an antigen(s). For example, the adenoviral vector can comprise two or more nucleic acid sequences that encode the same or different antigens and are operably linked to different promoters displaying distinct expression profiles. In this regard, a first promoter can be selected to mediate an initial peak of antigen production, thereby priming the immune system against an encoded antigen. A second promoter can be selected to drive production of the same or different antigen such that expression peaks several days after that of the first promoter, thereby "boosting" the immune system against the antigen. Alternatively, a hybrid promoter can be constructed which combines the desirable aspects of multiple promoters. For example, a CMV-Rous Sarcoma Virus hybrid promoter combining the CMV promoter's initial rush of activity with the Rous Sarcoma Virus promoter's high maintenance level of activity can be employed. In that antigens can be toxic to eukaryotic cells, it may be advantageous to modify the promoter to decrease activity in complementing cell lines used to propagate the adenoviral vector.

To optimize protein production, preferably the *Plasmodium* antigen-encoding nucleic acid sequence further comprises a polyadenylation site following the coding sequence. Any suitable polyadenylation sequence can be used, including a synthetic optimized sequence, as well as the polyadenylation sequence of BGH (Bovine Growth Hormone), polyoma virus, TK (Thymidine Kinase), EBV (Epstein Barr Virus), mouse globin D protein, and the papillomaviruses, including human papillomaviruses and BPV (Bovine Papilloma Virus). A preferred polyadenylation sequence is the SV40 (Simian Virus-40) polyadenylation sequence. Also, preferably all the proper transcription signals (and translation signals, where appropriate) are correctly arranged such that the nucleic acid sequence is properly expressed in the cells into which it is introduced. If desired, the nucleic acid sequence also can incorporate splice sites (i.e., splice acceptor and splice donor sites) to facilitate mRNA production.

If the nucleic acid sequence encodes a processed or secreted protein or peptide, or a protein that acts intracellularly, preferably the nucleic acid sequence further comprises the appropriate sequences for processing, secretion, intracellular localization, and the like. The nucleic acid sequence can be operably linked to a signal sequence, which targets a protein to cellular machinery for secretion. Appropriate signal sequences include, but are not limited to, leader sequences for immunoglobulin heavy chains and cytokines (see, for example, Ladunga et al., *Current Opinions in*

*Biotechnology*, 11: 13-18 (2000)). Other protein modifications can be required to secrete a protein from a host cell, which can be determined using routine laboratory techniques. Preparing expression constructs encoding antigens and signal sequences is further described in, for example, U.S. Pat. No. 6,500,641. Methods of secreting non-secretable proteins are further described in, for example, U.S. Pat. No. 6,472,176, and International Patent Application Publication WO 2002/048377.

*Plasmodium* antigens encoded by the one or more nucleic acid sequences can be modified to attach or incorporate the antigen on a host cell surface. In this respect, the antigen can comprise a membrane anchor, such as a gpi-anchor, for conjugation onto a cell surface. A transmembrane domain can be fused to the antigen to incorporate a terminus of the antigen protein into the cell membrane. Other strategies for displaying peptides on a cell surface are known in the art and are appropriate for use in the context of the invention.

The composition is a physiologically acceptable (e.g., pharmaceutically acceptable) composition, which comprises a carrier, preferably a physiologically (e.g., pharmaceutically) acceptable carrier. Any suitable carrier can be used within the context of the invention, and such carriers are well known in the art. The choice of carrier will be determined, in part, by the particular use of the composition (e.g., administration to an animal) and the particular method used to administer the composition. The composition optionally can be sterile.

Suitable compositions include aqueous and non-aqueous isotonic sterile solutions, which can contain anti-oxidants, buffers, and bacteriostats, and aqueous and non-aqueous sterile suspensions that can include suspending agents, solubilizers, thickening agents, stabilizers, and preservatives. The composition can be presented in unit-dose or multi-dose sealed containers, such as ampules and vials, and can be stored in a freeze-dried (lyophilized) condition requiring only the addition of the sterile liquid carrier, for example, water, immediately prior to use. Extemporaneous solutions and suspensions can be prepared from sterile powders, granules, and tablets. Preferably, the carrier is a buffered saline solution. The composition can be generated in accordance with conventional techniques described in, e.g., *Remington: The Science and Practice of Pharmacy*, 21$^{st}$ Edition, Lippincott Williams & Wilkins, Philadelphia, Pa. (2001).

When the composition comprises an adenoviral vector, the composition preferably is free of replication-competent adenovirus. In addition, the composition preferably is formulated to protect the adenoviral vector from damage prior to administration. For example, the composition can be formulated to reduce loss of the adenoviral vector on devices used to prepare, store, or administer the adenoviral vector, such as glassware, syringes, or needles. The composition can be formulated to decrease the light sensitivity and/or temperature sensitivity of the adenoviral vector. To this end, the composition preferably comprises a pharmaceutically acceptable liquid carrier, such as, for example, those described above, and a stabilizing agent selected from the group consisting of polysorbate 80, L-arginine, polyvinylpyrrolidone, trehalose, and combinations thereof. Use of such a composition will extend the shelf life of the adenoviral vector, and facilitate its administration. Formulations for adenoviral vector-containing compositions are further described in, for example, U.S. Pat. No. 6,225,289, U.S. Pat. No. 6,514,943, and International Patent Application Publication WO 2000/034444.

The composition also can be formulated to enhance transduction efficiency of the composition. In addition, one of ordinary skill in the art will appreciate that the isolated *Plasmodium* polypeptides and/or nucleic acid sequences can be present in a composition with other therapeutic or biologically-active agents. For example, factors that control inflammation, such as ibuprofen or steroids, can be part of the composition to reduce swelling and inflammation associated with in vivo administration of the composition. Antibiotics, i.e., microbicides and fungicides, can be present to treat existing infection and/or reduce the risk of future infection, such as infection associated with gene transfer procedures.

The invention further provides a method of inducing a protective immune response against a *Plasmodium* parasite in a mammal. The method comprises administering to the mammal the inventive composition comprising isolated *Plasmodium* polypeptides or nucleic acid sequences, whereupon a protective immune response against a *Plasmodium* parasite in the mammal is induced. When the composition comprises one or more *Plasmodium* nucleic acid sequences, the one or more nucleic acid sequences encoding the *Plasmodium* polypeptides are expressed in the mammal to produce the *Plasmodium* polypeptide. In accordance with the invention, the composition is administered to a mammal, most preferably a human. The human preferably is in a population that has a high risk of acquiring *Plasmodium* parasites. Such high-risk populations include residents of, and travelers to, parts of Africa, Asia, the Middle East, Central and South America, Hispaniola, and Oceania, as well as military personnel deployed to these areas.

The immune response can be directed against any *Plasmodium* species that infects a particular mammal, such as those described herein. Preferably, the mammal is a human and the immune response is directed against a human-infecting *Plasmodium* species. Most preferably, the immune response is directed against *Plasmodium falciparum* and/or *Plasmodium vivax*. The immune response can be a humoral immune response, a cell-mediated immune response, or, desirably, a combination of humoral and cell-mediated immunity. Ideally, the immune response provides protection to the animal, typically a mammal such as a human, upon subsequent challenge with *Plasmodium*. The inventive method also can be used for antibody production and harvesting.

To enhance the immune response generated against a *Plasmodium* antigen, the composition also can comprise an immune stimulator, or a nucleic acid sequence that encodes an immune stimulator. Immune stimulators also are referred to in the art as "adjuvants," and include, for example, cytokines, chemokines, or chaperones. Cytokines include, for example, Macrophage Colony Stimulating Factor (e.g., GM-CSF), Interferon Alpha (IFN-α), Interferon Beta (IFN-β), Interferon Gamma (IFN-γ), interleukins (IL-1, IL-2, IL-4, IL-5, IL-6, IL-8, IL-10, IL-12, IL-13, IL-15, IL-16, and IL-18), the TNF family of proteins, Intercellular Adhesion Molecule-1 (ICAM-1), Lymphocyte Function-Associated antigen-3 (LFA-3), B7-1, B7-2, FMS-related tyrosine kinase 3 ligand, (Flt3L), vasoactive intestinal peptide (VIP), and CD40 ligand. Chemokines include, for example, B Cell-Attracting chemokine-1 (BCA-1), Fractalkine, Melanoma Growth Stimulatory Activity (MGSA) protein, Hemofiltrate CC chemokine 1 (HCC-1), Interleukin 8 (IL-8), Interferon-stimulated T-cell alpha chemoattractant (I-TAC), Lymphotactin, Monocyte Chemotactic Protein 1 (MCP-1), Monocyte Chemotactic Protein 3 (MCP-3), Monocyte Chemotactic Protein 4 (CP-4), Macrophage-Derived Chemokine (MDC), a macrophage inflammatory protein (MIP), Platelet Factor 4

(PF4), RANTES, BRAK, eotaxin, exodus 1-3, and the like. Chaperones include, for example, the heat shock proteins Hsp170, Hsc70, and Hsp40.

The composition ideally comprises a "therapeutically effective amount" of the isolated *Plasmodium* polypeptide or polypeptides. A "therapeutically effective amount" refers to an amount effective, at dosages and for periods of time necessary, to achieve a desired therapeutic result. The therapeutically effective amount may vary according to factors such as the disease state, age, sex, and weight of the individual, and the ability of the *Plasmodium* polypeptide to elicit a desired response in the individual. For example, a therapeutically effective amount of a *Plasmodium* polypeptide of the invention is an amount which ameliorates a malaria infection in a human.

Alternatively, the pharmacologic and/or physiologic effect may be prophylactic, i.e., the effect completely or partially prevents a disease or symptom thereof. In this respect, the inventive method comprises administering a "prophylactically effective amount" of the composition. A "prophylactically effective amount" refers to an amount effective, at dosages and for periods of time necessary, to achieve a desired prophylactic result (e.g., prevention of *Plasmodium* infection or onset of malaria). For example, a prophylactically effective amount of a *Plasmodium* polypeptide of the invention is an amount which protects a human upon subsequent challenge with *Plasmodium*.

In embodiments where the composition comprises an adenoviral vector comprising one or more nucleic acid sequences that encode a *Plasmodium* polypeptide, the composition comprises a "therapeutically effective amount" of the adenoviral vector, i.e., a dose of adenoviral vector which provokes a desired immune response in the mammal. Desirably, a single dose of adenoviral vector comprises about $1 \times 10^5$ or more particles (which also are referred to as particle units (pu)) of the adenoviral vector, e.g., about $1 \times 10^6$ or more particles, about $1 \times 10^7$ or more particles, about $1 \times 10^8$ or more particles, about $1 \times 10^9$ or more particles, or about $3 \times 10^9$ or more particles of the adenoviral vector. Alternatively, or in addition, a single dose of adenoviral vector comprises about $3 \times 10^{14}$ particles or less of the adenoviral vector, e.g., about $1 \times 10^{13}$ particles or less, about $1 \times 10^{12}$ particles or less, about $3 \times 10^{11}$ particles or less, about $1 \times 10^{11}$ particles or less, about $1 \times 10^{10}$ particles or less, or about $1 \times 10^9$ particles or less of the adenoviral vector. Thus, a single dose of adenoviral vector can comprise a quantity of particles of the adenoviral vector in a range defined by any two of the aforementioned values. For example, a single dose of adenoviral vector can comprise $1 \times 10^5$-$1 \times 10^{14}$ particles, $1 \times 10^7$-$1 \times 10^{12}$ particles, $1 \times 10^8$-$1 \times 10^{11}$ particles, $3 \times 10^8$-$3 \times 10^{11}$ particles, $1 \times 10^9$-$1 \times 10^{12}$ particles, $1 \times 10^9$-$1 \times 10^{11}$ particles, $1 \times 10^9$-$1 \times 10^{10}$ particles, or $1 \times 10^{10}$-$1 \times 10^{12}$ particles, of the adenoviral vector. In other words, a single dose of adenoviral vector can comprise, for example, about $1 \times 10^6$ pu, $2 \times 10^6$ pu, $4 \times 10^6$ pu, $1 \times 10^7$ pu, $2 \times 10^7$ pu, $4 \times 10^7$ pu, $1 \times 10^8$ pu, $2 \times 10^8$ pu, $3 \times 10^8$ pu, $4 \times 10^8$ pu, $1 \times 10^9$ pu, $2 \times 10^9$ pu, $3 \times 10^9$ pu, $4 \times 10^9$ pu, $1 \times 10^{10}$ pu, $2 \times 10^{10}$ pu, $3 \times 10^{10}$ pu, $4 \times 10^{10}$ pu, $1 \times 10^{11}$ pu, $2 \times 10^{11}$ pu, $3 \times 10^{11}$ pu, $4 \times 10^{11}$ pu, $1 \times 10^{12}$ pu, $2 \times 10^{12}$ pu, $3 \times 10^{12}$ pu, or $4 \times 10^{12}$ pu of the adenoviral vector.

Administration of the inventive composition can be one component of a multistep regimen for inducing a protective immune response against *Plasmodium* parasites (e.g., *Plasmodium falciparum* and/or *Plasmodium vivax*) in a mammal. In this respect, the method of inducing a protective immune response can further comprise administering to the mammal a boosting composition after administering the inventive composition to the mammal. In this embodiment, therefore, the immune response is "primed" upon administration of the inventive composition, and is "boosted" upon administration of the boosting composition. Alternatively, the inventive method further comprises administering to the mammal a priming composition to the mammal prior to administering the inventive composition to the mammal. In this embodiment, therefore, the immune response is "primed" upon administration of the priming composition, and is "boosted" upon administration of the inventive composition.

In one embodiment, the *Plasmodium* polypeptide(s) present in, or encoded by a vector present in, the priming composition and the boosting composition are desirably the same. For example, if the priming composition comprises a hypothetical *Plasmodium* "protein A," then the boosting composition also comprises "protein A," or comprises a vector which encodes "protein A." At least one of the priming composition or the boosting composition desirably comprises an adenoviral vector that comprises a nucleic acid sequence encoding a *Plasmodium* antigen, while the other of the priming composition and the boosting composition can comprise the inventive composition or a different effective agent, though desirably a gene transfer vector that comprises a nucleic acid sequence encoding a *Plasmodium* antigen. Any gene transfer vector can be employed, including viral and non-viral gene transfer vectors. Examples of suitable viral gene transfer vectors include, but are not limited to, retroviral vectors, adeno-associated virus vectors, vaccinia virus vectors, herpesvirus vectors, parainfluenza-RSV chimeric vectors (PIV-RSV), and adenoviral vectors. Examples of suitable non-viral vectors include, but are not limited to, plasmids, liposomes, and molecular conjugates (e.g., transferrin). Preferably, the priming composition or the boosting composition comprises a plasmid or an adenoviral vector. Alternatively, an immune response can be primed or boosted by administration of a *Plasmodium* protein itself (e.g., any of the *Plasmodium* proteins described herein) with or without a suitable adjuvant (e.g., alum, QS-21, insulin-derived adjuvant, etc.), a live-attenuated *Plasmodium* parasite, and the like. When the priming composition or the boosting composition comprises an adenoviral vector, the adenoviral vector can be, or can be derived from, any adenovirus that infects a human or non-human animal, such as those described herein. In this respect, the priming composition or the boosting composition can comprise a human adenoviral vector (e.g., serotype 5, 28, or 35), a simian adenoviral vector (such as described in, e.g., International Patent Application Publication WO 2011/057254), or a *gorilla* adenoviral vector. For example, a priming composition containing a human serotype 5 adenoviral vector can be administered to a human, followed by administration of a boosting composition containing the inventive composition comprising one or more isolated *Plasmodium* polypeptides described herein (i.e., a "heterologous" prime-boost regimen). Alternatively, a priming composition containing the inventive composition comprising one or more isolated *Plasmodium* polypeptides described herein can be administered to a human, followed by administration of a boosting composition containing a human serotype 5 adenoviral vector. In another embodiment, the priming composition contains an adenoviral vector of a first serotype comprising a nucleic acid sequence encoding a *Plasmodium* antigen, and the boosting composition contains an adenoviral vector of a different serotype comprising a nucleic acid sequence encoding the same *Plasmodium* antigen as the first adenoviral vector. Alternatively, the priming composition can contain a plasmid that comprises a nucleic acid sequence encoding a *Plasmodium* antigen, and the boosting composition can contain the inventive composition comprising an adenoviral vector. In yet another embodiment, the inventive composition comprising one or more isolated *Plasmodium* polypeptides can be administered to a human, followed by a second administration of the same composition (i.e., a "homologous" prime-boost regimen). One of ordinary skill in the art will appreciate that any combination of vectors encoding one or more *Plasmodium* antigens and/or *Plasmodium* polypeptides themselves can be employed as the priming and/or boosting compositions in conjunction with the inventive composition described herein.

Administration of the priming composition and the boosting composition can be separated by any suitable timeframe (e.g., at least any of about 1 week, 2 weeks, 4 weeks, 8 weeks, 12 weeks, 16 weeks, 24 weeks, 52 weeks, 2 years, and 5 years, or any range defined by any two of the foregoing values). The boosting composition preferably is administered to a mammal (e.g., a human) at least about 2 weeks (e.g., at least any of about 3 weeks, 4 weeks, 5 weeks, 6 weeks, 7 weeks, 8 weeks, 9 weeks, 10 weeks, 11 weeks, 12 weeks, 13 weeks, 14 weeks, 15 weeks, 16 weeks, 20 weeks, 24 weeks, 28 weeks, 35 weeks, 40 weeks, 50 weeks, 52 weeks, 2 years, and 5 years, or any range defined by any two of the foregoing values) following administration of the priming composition. More than one dose of priming composition and/or boosting composition can be provided in any suitable timeframe. The dose of the priming composition and boosting composition administered to the mammal depends on a number of factors, including the extent of any side-effects, the particular route of administration, and the like.

The following examples further illustrate the invention but, of course, should not be construed as in any way limiting its scope.

EXAMPLE 1

This example demonstrates a method for screening and isolating *Plasmodium* antigen sequences that provide protection against malaria challenge.

Adenovirus-based microarray ("adeno-array") technology (see, e.g., U.S. Patent Application Publication 2010/0222234) was used for high-throughput discovery of pre-erythrocytic *Plasmodium falciparum* antigens using orthologs identified in a *P. yoelii* (Py) mouse model. Specifically, bioinformatics data mining using publicly available genomic and proteomic databases was performed to identify highly expressed *P. yoelii* pre-erythrocytic antigens. Based on expression abundance data from microarray analysis and protein mass spectrometry analysis by several research groups, 300 sporozoite stage and liver stage candidate *P. yoelii* genes with identifiable *P. falciparum* orthologs were prioritized for generation of an adeno-array.

The candidate *P. yoelii* genes were cloned into a high-level adenovirus vector-based expression cassette using high-throughput methodologies (such as those described in, e.g., U.S. Patent Application Publication 2010/0222234) to produce an adeno-array. Specifically, PCR-amplified candidate antigens genes were first cloned into a pCR8/GW/Topo cloning vector (Life Technologies, Carlsbad, Calif.). The *P. yoelii* genes were then individually subcloned into a CMV expression cassette which resides in a plasmid containing the human adenovirus 5 genome in which the E1 and E3 regions were deleted. The CMV expression cassette resides in the E1 region of this plasmid. Cloning was carried out using the attR1-CmR-ccB-attR2 lambda recombination technology (Life Technologies, Carlsbad, Calif.). To construct the adenoviral vectors, the adenoviral genomes were liberated from the plasmid backbone and used to transfect 293-ORF6 complementing cells (Brough et al., *J. Virol.*, 71: 9206-9213 (1997)).

A20/2J antigen presenting cells (APCs) were infected with adenoviral vectors expressing Py antigens from the adeno-array and used as targets in an IFNγ assay to recall T-cell responses from mice immunized with *Plasmodium yoelii*-irradiated sporozoites. The infected APCs were then incubated with splenocytes from mice immunized with known protective regimens of Radiation Attenuated Sporozoites (RAS), and antigen-specific $CD8^{30}T$ cell responses were measured by Intercellular Cytokine Staining (ICS). Adenoviral vectors encoding the Py circumsporozoite protein (PyCSP) and lacking a transgene (AdNull) were used as controls. New antigens that recalled relatively frequent IFNγ responses in RAS-immunized, but not in naïve mice, were identified. The putative gene product encoded by each of the *P. yoelii* antigens and their corresponding amino acid SEQ ID NOs, as well as the SEQ ID NOs for the corresponding *P. falciparum* and *P. vivax* orthologs, are set forth in Table 1.

TABLE 1

| Putative Gene Product | *P. yoelii* (17XNL) SEQ ID NO | *P. falciparum* (3D7) Ortholog SEQ ID NO | *P. vivax* (SaI-1) Ortholog SEQ ID NO |
|---|---|---|---|
| putative WD-40 repeat protein | 122 | 149 | 176 |
| serine hydroxymethyl-transferase, mitochondrial precursor | 123 | 150 | 177 |
| 49 kDa zinc finger protein | 124 | 151 | 178 |
| hypothetical protein | 98 | 99 | 100 |
| 60S ribosomal protein L6, putative | 49 | 50 | 51 |
| *Arabidopsis thaliana* At1g20220/T20H2_3-related | 24 | 25 | 26 |
| translation elongation factor EF-1, subunit alpha | 34 | 35 | 36 |
| adenosine deaminase | 14 | 15 | 16 |
| translation initiation factor eIF-5A | 125 | 152 | 179 |
| stress-induced protein sti1-like protein | 126 | 153 | 180 |
| ethylene-inducible protein hever | 116 | 117 | 118 |
| DNA replication licensing factor mis5 | 127 | 154 | 181 |
| pyruvate dehydrogenase E1 alpha subunit | 128 | 155 | 182 |
| ribosomal protein var1, putative | 129 | 156 | 183 |
| asparagine-rich protein, putative | 130 | 157 | 184 |
| succinyl-coa ligase beta-chain, hydrogenosomal precursor | 131 | 158 | 185 |
| *Drosophila melanogaster* RE21692p, putative | 132 | 159 | 186 |
| cyclophilin | 133 | 160 | 187 |
| hypothetical protein | 134 | 161 | 188 |
| Protein of unknown function, putative | 135 | 162 | 189 |
| *Homo sapiens* RIKEN cDNA 1600015H11 gene-related | 136 | 163 | 190 |

TABLE 1-continued

| Putative Gene Product | P. yoelii (17XNL) SEQ ID NO | P. falciparum (3D7) Ortholog SEQ ID NO | P. vivax (Sal-1) Ortholog SEQ ID NO |
|---|---|---|---|
| translation initiation factor if-2 | 63 | 64 | 65 |
| Leucine Rich Repeat, putative | 137 | 164 | 191 |
| hypothetical protein | 138 | 165 | 192 |
| DnaJ homolog, putative | 139 | 166 | 193 |
| ADP-ribosylation factor GTPase-activating protein | 140 | 167 | 194 |
| ubiquitin carboxyl-terminal hydrolase isozyme 15 | 74 | 75 | 76 |
| elongation factor 3 related protein PFEF3-rl | 141 | 168 | 195 |
| eukaryotic translation initiation factor 3 39 kDa subunit | 142 | 169 | 196 |
| hypothetical protein | 90 | 91 | 93 |
| putative protein | 84 | 85 | 86 |
| Rab1 protein | 143 | 170 | 197 |
| peptidyl-prolyl cis-trans isomerase, cyclophilin-type | 144 | 171 | 198 |
| Ribosomal protein S7e | 145 | 172 | 199 |
| similar to RIKEN cDNA 2010107D16 gene | 146 | 173 | 200 |
| neurofilament protein H form H2 | 147 | 174 | 201 |
| 60S acidic ribosomal protein P2 | 148 | 175 | |
| putative protein phosphatase 2C | 213 | 214 | 215 |
| putative small nucleolar ribonucleoprotein gar1 | 216 | 217 | 218 |
| 26s protease regulatory subunit 6a (tat-binding protein homolog 1) (tbp-1) | 219 | 220 | 221 |
| Drosophila melanogaster CG1349 gene product | 222 | 223 | 224 |
| putative ribosomal protein S19e | 225 | 226 | 227 |
| glycyl-tRNA synthetase | 228 | 229 | 230 |
| transketolase | 231 | 232 | 233 |
| asparaginyl-tRNA synthetase | 234 | 235 | 236 |
| putative acyl carrier protein | 237 | 238 | 239 |
| putative calcyclin binding protein | 240 | 241 | 242 |
| putative glycerol kinase | 243 | 244 | 245 |
| elongation factor 2 | 246 | 247 | 248 |
| hexokinase | 249 | 250 | 251 |
| pyruvate dehydrogenase E1 beta subunit | 252 | 253 | 254 |
| U43539 hepatocyte erythrocyte protein 17 kDa | 255 | 256 | 257 |
| protein kinase domain | 258 | 259 | 260 |
| merozoite surface protein 1 precursor | 261 | 262 | 263 |
| merozoite surface protein 7 precursor | 264 | 265, 266, 267 | 268 |
| glutathione s-transferase | 269 | N/A | 270 |
| S-adenosylmethionine synthetase | 271 | 272 | 273 |

Antigens that recalled the most robust T cell responses were selected and their capacity to protect mice from a P. yoelii sporozoite challenge was tested. In this regard, 100 μg of plasmid vector expressing each of the above Py antigens were injected into mice at the start (Day 0) of the experiment, and 6 weeks later, animals were boosted by intramuscular (IM) injection of adenoviral vectors expressing the same antigens at $1 \times 10^{10}$ particles per mouse. Immunized mice were challenged with 300 or 600 live sporozoites two weeks after boost. Tail vein bleeds were performed from 6 to 14 days after live sporozoite challenge and blood films were prepared for analysis of blood-stage parasitemia. Outbred CD1 mice were immunized with a DNA prime-adenovirus boost regimen and sterile protection was measured following sporozoite challenge as set forth in Table 2.

TABLE 2

| | | Sterile protection | |
|---|---|---|---|
| Antigen | SEQ ID NO | # Protected/# challenged | % protected |
| PyCSP | | 53/112 | 47% |
| GV0032 | 24 | 16/41 | 39% |
| GV0041 | 14 | 10/42 | 24% |
| GV0033 | 34 | 6/28 | 21% |
| GV0043 | 125 | 1/14 | 7% |
| GV0074 | 213 | 4/14 | 29% |
| GV0176 | 74 | 7/28 | 25% |
| GV0196 | 90 | 7/28 | 25% |
| GV0004 | 123 | 3/14 | 21% |
| GV0013 | 124 | 3/14 | 21% |
| GV0199 | 84 | 6/28 | 21% |
| GV0014 | 98 | 8/42 | 19% |
| GV0139 | 216 | 3/14 | 21% |
| GV0104 | 271 | 1/14 | 7% |
| Naïve control | | 11/112 | 10% |
| AdNull | | 8/112 | 7% |

The results of this example demonstrate the identification of new Plasmodium antigens that can induce a protective immune response against malaria in a mammal.

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and "at least one" and similar referents in the context of describing the invention (especially in the context of the following claims) are to be construed to cover both the singular and the plural, unless otherwise indicated herein or clearly contradicted by context. The use of the term "at least one" followed by a list of one or more items (for example, "at least one of A and B") is to be construed to mean one item selected from the listed items (A or B) or any combination of two or more of the listed items (A and B), unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Preferred embodiments of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein.

Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (273 sequences)

SEQ ID NO: 1 - protein, 21 aa, Plasmodium yoelii
  MISC_FEATURE (6)..(6): X is a lysine (K) residue, a glutamic acid (E) residue, an arginine (R) residue, an isoleucine (I) residue, a leucine (L) residue, a cysteine (C) residue, or a valine (V) residue.
  MISC_FEATURE (9)..(9): X is a lysine (K) residue, a glutamic acid (E) residue, an arginine (R) residue, an isoleucine (I) residue, a leucine (L) residue, a cysteine (C) residue, or a valine (V) residue.
  MISC_FEATURE (11)..(11): X is a lysine (K) residue, a glutamic acid (E) residue, an arginine (R) residue, an isoleucine (I) residue, a leucine (L) residue, a cysteine (C) residue, or a valine (V) residue.
  MISC_FEATURE (14)..(14): X is a lysine (K) residue, a glutamic acid (E) residue, an arginine (R) residue, an isoleucine (I) residue, a leucine (L) residue, a cysteine (C) residue, or a valine (V) residue.
KKERYXIWXRXPKXELHCHLD

SEQ ID NO: 2 - protein, 15 aa, Plasmodium yoelii
KYKEGVVLMEFRYSP

SEQ ID NO: 3 - protein, 25 aa, Plasmodium yoelii
  MISC_FEATURE (6)..(6): X is a histidine (H) residue, a tryptophan (W) residue, a phenylalanine (F) residue, an isoleucine (I) residue, an asparagine (N) residue, or a glutamic acid (E) residue
  MISC_FEATURE (9)..(9): X is a histidine (H) residue, a tryptophan (W) residue, a phenylalanine (F) residue, an isoleucine (I) residue, an asparagine (N) residue, or a glutamic acid (E) residue
  MISC_FEATURE (10)..(10): X is a histidine (H) residue, a tryptophan (W) residue, a phenylalanine (F) residue, an isoleucine (I) residue, an asparagine (N) residue, or a glutamic acid (E) residue
EDLAKXAVXXKYKEGVVLMEFRYSP

SEQ ID NO: 4 - protein, 29 aa, Plasmodium yoelii
  MISC_FEATURE (10)..(10): X is a glutamine (Q) residue, a methionine (M) residue, or a lysine (K) residue
KSMDTHPIRXLYDAGVKVSVNSDDPGMFL

SEQ ID NO: 5 - protein, 21 aa, Plasmodium yoelii
KKERYEIWRRIPKVELHCHLD

SEQ ID NO: 6 - protein, 21 aa, Plasmodium falciparum
KKERYKIWKRLPKCELHCHLD

SEQ ID NO: 7 - protein, 21 aa, Plasmodium vivax
KKERYKIWKRIPKCELHCHLD

SEQ ID NO: 8 - protein, 25 aa, Plasmodium yoelii
EDLAKWAVIEKYKEGVVLMEFRYSP

SEQ ID NO: 9 - protein, 25 aa, Plasmodium falciparum
EDLAKHAVFNKYKEGVVLMEFRYSP

SEQ ID NO: 10 - protein, 25 aa, Plasmodium vivax
EDLAKHAVFNKYKEGVVLMEFRYSP

SEQ ID NO: 11 - protein, 29 aa, Plasmodium yoelii
KSMDTHPIRKLYDAGVKVSVNSDDPGMFL

SEQ ID NO: 12 - protein, 29 aa, Plasmodium falciparum
KSMDTHPIRMLYDAGVKVSVNSDDPGMFL

SEQ ID NO: 13 - protein, 29 aa, Plasmodium vivax
KSMDTHPIRQLYDAGVKVSVNSDDPGMFL

SEQ ID NO: 14 - protein, 364 aa, Plasmodium yoelii
MMEIPTEEIKFLKKEDVQNIDLNGMSKKERYEIWRRIPKVELHCHLDLTFSAEFFLKWARKYNLQPNMSDDEILDHYLFTKEGKSLAEFIRKAISVSDLYRDYDFIEDLAKWAVIEKYKEGVVLMEFRYSPTFVSSSYGLDVELIHKAFIKGIKNATELLNNKIHVALICISDTGHAAASIKHSGDFAIKHKHDFVGFDHGGREIDLKDHKDVYHSVRDHGLHLTVHAGEDATLPNLNTLYTAINILNVERIGHGIRVSESDELIELVKKKDILLEVCPISNLLLNNVKSMDTHPIRKLYDAGVKVSVNSDDPGMFLSNINDNYEKLYIHLNFTLEEFMIMNNWAFEKSFVSDDVKSELKALYF

SEQ ID NO: 15 - protein, 367 aa, Plasmodium falciparum
MNCKNMDTSYEIINYLTKDELDIDLSCMDKKERYKIWKRLPKCELHCHLDVCFSVDFFLNVIRKYNIQPNMSDEEIIDYYLFSKPGKSLDEFVEKALRLTDIYIDYTVVEDLAKHAVFNKYKEGVVLMEFRYSPSFMSFKHNLDKDLIHEAIVKGLNEAVALLEYKIQVGLLCTGDGGLSHERMKEAAEFCIKHKKDFVGYDHAGHEVDLKPFKDIFDNIREEGISLSVHAGEDVSIPNLNSLYTAINLLHVKRIGHGIRVSESQELIDLVKEKDILLEVCPISNVLLNNVKSMDTHPIRMLYDAGVKVSVNSDDPGMFLTNITDNYEELYTHLNFTLADFMKMNLWAVQKSFVDPDIKNKIISKYF

SEQ ID NO: 16 - protein, 363 aa, Plasmodium vivax
MNILQEPIDFLKKEELKNIDLSQMSKKERYKIWKRIPKCELHCHLDLCFSADFFVSCIRKYNLQPNLSDEEVLDYYLFAKGGKSLGEFVEKAIKVADIFHDYEVIEDLAKHAVFNKYKEGVVLMEFRYSPTFVAFKYNLDIELIHQAIVKGIKEVVELLDHKIHVALMCIGDTGHEAANIKASADFCLKHKADFVGFDHGGHEVDLKEYKEIFDYVRESGVPLSVHAGEDVTLPNLNTLYSAIQVLKVERIGHGIRVAESQELIDMVKEKNILLEVCPISNVLLKNAKSMDTHPIRQLYDAGVKVSVNSDDPGMFLTNINDDYEELYTHLNFTLEDFMKMNEWALEKSFMDSNIKDKIKNLYF

SEQ ID NO: 17 - DNA, 1092 bp, Plasmodium yoelii
atgatggaaattccaactgaagaaataaagttcctcaaaaaggaagatgtacaaaacatcgatttaaacggaatgagtaaaaaagaaagatatgaaatatggagaagaattcccaaagttgaattacattgccatttagatttaacattttctgctgaattttttttaaaatgggctcgaaaatataatctacaacctaacatgtcagatgacgaaatacttgatcattatttatttacaaaagaaggaaaatcattagcagaatttattagaaaagcaataagtgtttctgatttatatagagattatgattttattgaagatttggccaaatgggcagttattgaaaaatataaagaaggtgttgttttaatggaatttcgatattcaccaacttttgtttcttcatcttatggattagatgtagaattgattcataaagcatttataaaaggaataaaaaatgctacagaattattaaacaataaaatacatgttgcattaatatgtattagtgatactggacatgctgctgctagtattaaacattctggagattttgcaattaaacataaacatgatttcgttggttttgatcatggtggacgtgaaatagatttaaaagatcataaagatgtatatcattcagttagggatcatggtttacatctaactgtacatgcaggtgaagatgcaactttaccaaatctaaatactttatatactgctatcaatattttaaatgttgaacgtattggtcatggtataagagtttcagaatcagatgaactaattgaattagttaaaaaaaaagatatcttattagaagtatgcccaatatctaatcttttattaaataatgttaaatctatggatacacatccaattagaaaattatatgatgctggtgttaaagtatctgttaattccgatgatcctggaatgtttttatcaaacataaatgataattacgaaaaattatatatccatctaaattttacattagaagaatttatgattatgaataactgggcttttgaaaaatctttcgttagtgacgatgttaaaagcgagcttaaagcgttgtacttt

SEQ ID NO: 18 - DNA, 1101 bp, Plasmodium falciparum
atgaattgtaagaatatggatacttcatatgagattattaattatttaacaaaggatgagcttgatatagatttatcatgtatggataagaaggaaagatataaaatatggaaacgacttcccaaatgcgaattacattgtcatttagatgtatgtttttctgttgatttttttttgaatgttattcgtaaatataatatacaaccaaatatgagtgatgaagaaattatcgattattatttattttccaaacctggtaaatcattagatgaatttgttgaaaaagctttaaggttaaccgatatatatattgattatactgttgttgaagatttagcaaaacatgctgtatttaacaaatataaagaaggtgttgttttaatggagtttcgttattctccttctttcatgtccttcaaacataatttagataaagatcttatccatgaagctattgttaaaggtcttaatgaagccgttgctttgttagaatataaaatacaagtaggattactttgtacaggtgatggtggcctttcacatgaaagaatgaaagaagctgctgaattctgtattaaacataaaaaagattttgttggttatgatcatgctggacatgaagttgaccttaaaccatttaaagatatctttgataatataagagaagaaggtatctccttatctgtacacgctggagaagatgtaagcataccaaatttaaattctctttatacagccatcaacttattacatgttaaaagaattggacatggtattagagtttcagaatctcaagaattaattgacttagtaaaagaaaaagacatcttgctagaagtctgtcctatatctaatgtattattaaacaatgtcaaatctatggacacacaccctattagaatgttgtatgatgctggtgtaaaagtgtcggtaaattctgatgatccaggaatgttcttaaccaacattacagataattatgaagaattatatacacacttaaattttacattggctgattttatgaaaatgaacctctgggctgtgcaaaaatcttttgtagacccagatataaaaaataaaattataagtaaatatttt

SEQ ID NO: 19 - DNA, 1089 bp, Plasmodium vivax
atgaacatcctgcaagaacccatcgacttcctcaaaaaggaggagctgaaaaacatcgacctatcccagatgagcaaaaaggaaagatacaaaatttggaagaggataccaaagtgtgaattacactgccatctggacctctgcttctccgcagacttcttcgtcagctgcattcgaaaatataatttgcagccgaatttatctgatgaggaggtgctagattattacttgtttgcaaaaggagggaagtctttaggagagttcgtcgaaaaggcaataaaagtggcagatatatttcacgactacgaagtgattgaggatttggccaagcacgcagtgtttaacaaatataaagaaggagtcgtcctgatggaattccgttactctccaacgtttgttgccttcaagtataaccttgacattgagctcattcaccaagcgatcgtgaagggcataaaggaagtcgtagaattgttagaccataaaattcacgtggctctcatgtgcattggagatacaggccatgaagcagcaaacattaaagcttctgctgatttttgcttaaaacataaggcagattttgtaggctttgatcacggtggacatgaagtagatttaaaagagtataaagaaattttcgattacgtgagagaaagtggtgtgcctctttctgtccacgcaggggaagatgtgactctcccaaatttaaacaccctatactcagctatacaagtacttaaagtggaaagaattggacacggaattagggttgctgaatcgcaagaactaatcgatatggttaaggagaaaaatattttacttgaagtttgccccatttcaaatgtgctgctgaaaaatgcaaagtccatggatactcaccctattagacaattgtacgatgctggagtgaaggtctctgtcaattcggatgacccaggaatgttcctcaccaacatcaatgacgattacgaggagttatacacccacttgaattttaccctcgaagattttatgaagatgaatgagtgggctttggagaagtccttcatggattcgaacataaaggacaaaataaagaacctctacttt

SEQ ID NO: 20 - protein, 33 aa, Plasmodium yoelii
MKKDREPIDEDEMRITSTGRMTNYVNYGAKILG

SEQ ID NO: 21 - protein, 30 aa, Plasmodium yoelii
KIKATGNAIGKAVTLAEIIKRRFKGLHQIT

SEQ ID NO: 22 - protein, 17 aa, Plasmodium yoelii
KDAGYQPPLDEKYVKEM

SEQ ID NO: 23 - protein, 24 aa, Plasmodium yoelii
  MISC_FEATURE (18)..(18): X be a serine (S) residue or a threonine (T) residue
KDAGYQPPLDEKYVKEMXPEEIVN

SEQ ID NO: 24 - protein, 241 aa, Plasmodium yoelii
MKKDREPIDEDEMRITSTGRMTNYVNYGAKILGEEDKKSLKIKATGNAIGKAVTLAEIIKRRFKGLHQITKCGSTVIADQYVSGQDNSEHVIQEKTVSFIDILLSRDQLDVKDAGYQPPLDEKYVKEMSPEEIVNSRPFRGRSFRPRFFRGFRGGGRGGFMRRGGYKFFGDRMYDSRNGFRDGRGYGGSFGRGGGFRSGGGMGGNGRGGFRGFRDGRDGDYRSGRGFRGGRNGFRGGRALS

SEQ ID NO: 25 - protein, 248 aa, Plasmodium falciparum
MKKDREPIDEDEMRITSTGRMTNYVNYGAKILGDEDKKSIKIKATGNAIGKAVTLAEIIKRRFKGLHQITRCGSTVITDQYVSGQDNSEHVVQEKTVSFIEILLSREQLDMKDAGYQPPLDEKYVKEMTPEEIVNSRPFRRGGFRPRFYRGFRGGRGGFLRRGGYRGFGDRVYEPRSSFRGGRGSGYGGNFGRGGYRSGGGMGGGFRGGFRGGFRGGRDGGYRGGNRGGSRSGFRGGRGGFRGGRALS

SEQ ID NO: 26 - protein, 241 aa, Plasmodium vivax
MKKDREPIDEDEMRITSTGRMTNYVNYGAKILGEEDKKSLKIKATGNAIGKAVTLAEIIKRRFKGLHQITRCGSTVITDQYVSGQDNNEHVVQEKTVSFIDILLSRDQLDVKDAGYQPPLDEKYVKEMSPEEIVNTRPFRGRGFRPRFFRGFRGGRGGFMRRGGYRPFGDRMYEGRNSFRGGRGYGGSFGRGGYRSGGGMGVSGRGGFRGGFRGGRDGGYRGGRGGFRGGRGGFRGGRALS

SEQ ID NO: 27 - DNA, 723 bp, Plasmodium yoelii
atgaagaaagatagagagccaatagacgaagatgaaatgagaattacatcaacaggtcgaatgaccaattatgttaactatggtgcaaaaatattaggagaggaagataagaagagtttaaaaattaaagccacgggaaatgcaattggtaaagccgtaactttagcagaaattataaaaagaagatttaaaggattacatcaaataactaaatgtggtagcacagttattgctgatcaatacgtaagtggccaagataatagcgaacatgttattcaagaaaaaacagtatcttttattgacatattattatcaagagatcaattagatgtaaaagatgcaggataccaaccacctttagatgaaaaatacgttaaagaaatgtcccctgaagaaattgtaaacagcaggccatttagaggaagaagttttaggcccagatttttccgtgggttcagaggcggtggccgtggtggctttatgagaagaggtggatacaaattctttggtgatagaatgtatgacagtagaaatggatttagagatggtagaggatatggtggaagtttcggacgtggtggtggattcagatcaggtggtggtatgggaggaaatggaagaggtggctttagaggattcagagatggaagagacggagattacagaagtggccgtggattcagaggaggtagaaacggattcagaggtggcagagccttatca

SEQ ID NO: 28 - DNA, 744 bp, Plasmodium falciparum
atgaagaaagatagagaaccaatagacgaagatgaaatgagaataacctcaaccggaaggatgaccaactatgttaactatggtgcaaaaatactaggagatgaagacaaaaaaagtataaaaattaaagcaacaggtaatgctattggaaaagctgtaacattagcagaaataataaaaagaagatttaaaggattacatcaaataaccagatgtggaagtacagttatcactgatcaatatgtaagtggacaagataatagcgaacatgtagtacaagaaaaaaccgtttcatttattgaaatattattatctagagaacaattagatatgaaagatgcaggttatcaaccacctttggatgagaaatatgtaaaagaaatgaccccagaagaaattgtcaattctaggccattcagaagaggtggatttagaccacgattttatagaggatttagaggaggaagaggtggatttttaagaagaggaggatatagaggttttggtgacagagtatatgaaccaagaagtagcttcagaggtggaagaggtagcggatatggtggaaatttcggaagaggtggatacagatcaggtggtggtatgggtggtggattcagaggtggattcagaggaggatttagaggtggaagagatggtggctacagaggtggaaacagaggaggtagcagaagtggatttagaggtggcagaggtggattcagaggtggaagagctttatca

SEQ ID NO: 29 - DNA, 723 bp, Plasmodium vivax
atgaagaaagatagagagccaatagacgaagatgaaatgagaatcacgtccaccggaaggatgaccaactatgtgaactatggtgccaaaattttaggggaagaagataaaaaaagcttgaaaataaaagccacgggaaacgccatcggaaaagcagtaactctagcggaaataatcaaaaggagatttaaagggttgcatcagattaccaggtgcggtagtacagtcatcacggaccagtacgttagtggacaagacaacaacgaacatgttgtgcaagagaaaaccgtttcttttattgacattctgctatcgagagatcagttagatgtgaaagacgcaggctaccaaccaccattggatgagaaatatgtgaaagaaatgtcacctgaagaaattgtgaacacgagaccatttagaggaagaggattcagacccagattcttccgtggatttagaggtggcagaggtgggttcatgagacgaggtggatataggccatttggagatagaatgtatgaaggtagaaacagctttagaggaggcagaggatatggtggcagttttggtagaggtggttacagatctggtggcggaatgggcgtatccggaagaggcggtttcagaggaggattccgtggaggcagagatggcggttaccgcggaggtagaggtggtttccgaggtggcagaggtggcttcagagggggcagggctttatca

SEQ ID NO: 30 - protein, 172 aa, Plasmodium yoelii
MGKEKTHINLVVIGHVDSGKSTTTGHIIYKLGGIDRRTIEKFEKESAEMGKGSFKYAWVLDKLKAERERGITIDIALWKFETPRYFFTVIDAPGHKDFIKNMITGTSQADVALLVVPAEVGGFEGAFSKEGQTKEHALLAFTLGVKQIVVGVNKMDTVKYSEDRYEEIKKEV

SEQ ID NO: 31 - protein, 170 aa, Plasmodium yoelii
DYLKKVGYQADKVDFIPISGFEGDNLIEKSDKTPWYKGRTLIEALDTMEPPKRPYDKPLRIPLQGVYKIGGIGTVPVGRVETGILKAGMVLNFAPSAVVSECKSVEMHKEVLEEARPGDNIGFNVKNVSVKEIKRGYVASDTKNEPAKGCSKFTAQVIILNHPGEIKNGY

SEQ ID NO: 32 - protein, 26 aa, Plasmodium yoelii
HISCKFLNIDSKIDKRSGKVVEENPK

SEQ ID NO: 33 - protein, 36 aa, Plasmodium yoelii
LEPKKPMVVETFTEYPPLGRFAIRDMRQTIAVGIIK

SEQ ID NO: 34 - protein, 443 aa, Plasmodium yoelii
MGKEKTHINLVVIGHVDSGKSTTTGHIIYKLGGIDRRTIEKFEKESAEMGKGSFKYAWVLDKLKAERERGITIDIALWKFETPRYFFTVIDAPGHKDFIKNMITGTSQADVALLVVPAEVGGFEGAFSKEGQTKEHALLAFTLGVKQIVVGVNKMDTVKYSEDRYEEIKKEVKDYLKKVGYQADKVDFIPISGFEGDNLIEKSDKTPWYKGRTLIEALDTMEPPKRPYDKPLRIPLQGVYKIGGIGTVPVGRVETGILKAGMVLNFAPSAVVSECKSVEMHKEVLEEARPGDNIGFNVKNVSVKEIKRGYVASDTKNEPAKGCSKFTAQVIILNHPGEIKNGYTPVLDCHTSHISCKFLNIDSKIDKRSGKVVEENPKAIKSGDSALVTLEPKKPMVVETFTEYPPLGRFAIRDMRQTIAVGIIKSVEKKEPGAVSAKAPAKK

SEQ ID NO: 35 - protein, 443 aa, Plasmodium falciparum
MGKEKTHINLVVIGHVDSGKSTTTGHIIYKLGGIDRRTIEKFEKESAEMGKGSFKYAWVLDKLKAERERGITIDIALWKFETPRYFFTVIDAPGHKDFIKNMITGTSQADVALLVVPAEVGGFEGAFSKEGQTKEHALLAFTLGVKQIVVGVNKMDTVKYSEDRYEEIKKEVKDYLKKVGYQADKVDFIPISGFEGDNLIEKSDKTPWYKGRTLIEALDTMEPPKRPYDKPLRIPLQGVYKIGGIGTVPVGRVETGILKAGMVLNFAPSAVVSECKSVEMHKEVLEEARPGDNIGFNVKNVSVKEIKRGYVASDTKNEPAKGCSKFTAQVIILNHPGEIKNGYTPVLDCHTSHISCKFLNIDSKIDKRSGKVVEENPKAIKSGDSALVSLEPKKPMVVETFTEYPPLGRFAIRDMRQTIAVGIIKSVEKKEPGAVTAKAPAKK

SEQ ID NO: 36 - protein, 443 aa, Plasmodium vivax
MGKEKTHINLVVIGHVDSGKSTTTGHIIYKLGGIDRRTIEKFEKESAEMGKGSFKYAWVLDKLKAERERGITIDIALWKFETPRYFFTVIDAPGHKDFIKNMITGTSQADVALLVVPAEVGGFEGAFSKEGQTKEHALLAFTLGVKQIVVGVNKMDTVKYSEDRYEEIKKEVRDYLKKVGYQADKVDFIPISGFEGDNLIEKSDKTPWYKGRTLIEALDTMEPPKRPYDKPLRIPLQGVYKIGGIGTVPVGRVETGILKAGMVLNFAPSAVVSECKSVEMHKEVLEEARPGDNIGFNVKNVSVKEIKRGYVASDTKNEPAKGCSKFTAQVIILNHPGEIKNGYSPVLDCHTAHISCKFLNIDSKIDKRSGKVVEENPKSIKSGDSALVSLEPKKPMVVETFTEYPPLGRFAIRDMRQTIAVGIIKAVEKKEPGAVSAKNPAKK

SEQ ID NO: 37 - DNA, 1329 bp, Plasmodium yoelii
atgggaaaggaaaaaactcacattaacttagtcgtcatcgggcatgtcgatagtggtaaatccacaactactggtcacattatttacaaattaggaggtattgatagaagaactattgaaaagttcgaaaaggaatcagctgaaatgggaaagggtagtttcaaatatgcatgggttttagataaacttaaggccgaaagagaaagaggtattactattgatatcgctttatggaaatttgaaaccccaagatatttcttcacagttattgatgcaccaggtcacaaagattttattaaaaatatgattactggtacctctcaagctgatgttgcattattagttgttccagctgaagttggtggttttgaaggtgctttctccaaggaaggtcaaaccaaagaacatgctttgttagcctttactttaggagttaaacaaattgttgttggtgttaacaagatggatacagttaaatattcagaagatcgttatgaagaaatcaagaaggaagttaaggattacttaaagaaggtaggatatcaagccgataaagttgactttatcccaatatccggttttgaaggtgataacttaattgaaaaatcagataaaaccccatggtataagggaagaacccttattgaagctttggatactatggaaccacccaaaagaccatatgacaaaccattaagaattccattacaaggtgtatacaaaatcggtggtatcggtactgtccctgtaggtcgtgttgaaactggtattttaaaagctggtatggtattaaacttcgctccatccgctgttgtttcggaatgtaaatctgttgaaatgcacaaagaagtattagaagaagccagaccaggagataacattggatttaacgttaaaaacgtatcagttaaagaaattaaaagaggatacgttgcttcagataccaagaatgaaccagctaagggatgctctaaatttacagcacaagttattatcttaaatcaccctggtgaaatcaaaaacggttataccccagttttagattgtcacacatcccacatttcttgtaaatttttaaatatcgactctaaaatcgataaacgttcaggaaaagttgttgaagaaaacccaaaagctatcaaatcaggagattcagctttagttactttagagccaaagaaacctatggttgttgaaactttcactgagtacccaccattaggaagatttgctattagagatatgagacaaaccattgccgtcggtattattaaatctgttgaaaagaaagaacccggagctgtctcagccaaagcaccagcaaaaaaa

SEQ ID NO: 38 - DNA, 1329 bp, Plasmodium falciparum
atgggtaaggaaaaaacacatattaacttagttgttattggtcacgtcgatagtggaaaatcaaccactacaggtcacattatttacaaattaggaggtatagatagaagaactattgaaaaatttgagaaagaatctgctgaaatgggtaagggtagttttaaatatgcatgggttttagataaacttaaggcagaaagagaaagaggtattaccattgatattgccttatggaaatttgaaaccccaaggtatttctttactgtcattgatgcaccaggtcacaaggattttattaaaaatatgattacaggtacatcacaagcagatgttgctttattagttgtcccagctgaagtaggtggtttcgaaggtgccttttcaaaggaaggtcaaacaaaggaacacgctttattagcatttaccttaggtgtaaaacaaattgttgtcggtgttaacaagatggatactgtcaaatattctgaagacagatatgaagaaattaaaaaagaagttaaggattacttgaagaaagtaggataccaagctgataaagttgattttattccaatttctggttttgaaggtgataatttaatcgaaaaatcagataaaacaccatggtataaaggaagaaccttaatagaagcccttgatactatggaaccaccaaagagaccttacgacaagccattaagaattccacttcaaggtgtttacaaaatcggtggtattggtaccgtccctgttggtcgtgttgaaacaggtatcttaaaagccggtatggttttaaacttcgctccatcagctgttgtgtctgaatgtaaatcagttgaaatgcacaaggaagttttggaagaagctagaccaggagacaacattggttttaacgtaaagaatgtttctgttaaagaaatcaagagaggttacgttgcttcagatactaaaaatgaaccagcaaaaggatgctccaaatttactgctcaagttattatattgaaccaccctggtgaaatcaaaaatggttataccccagttttggattgtcacacatctcacatttcatgtaaatttttaaacatcgactccaagatcgacaaacgttcaggtaaagttgttgaagaaaacccaaaagctatcaaatcaggagattcagctttagttagtttagaacctaagaaacctatggttgtcgaaacctttactgaatatccaccattaggaagatttgctattcgtgatatgagacaaaccattgctgtcggtatcattaaatcagttgaaaagaaagaacctggagctgtcacagctaaagcaccagccaaaaaa

SEQ ID NO: 39 - DNA, 1329 bp, Plasmodium vivax
atgggaaaggaaaaaacacatatcaacttagtcgttatcggccatgtcgatagtggaaaatccacgaccaccggtcatattatttacaagttgggaggtattgacaggagaaccatagaaaagtttgagaaagagtccgccgaaatgggtaagggtagttttaagtacgcgtgggtgttggataagctaaaggccgaaagagaaagaggtatcactatcgatatcgccttatggaagttcgaaacgcccaggtacttcttcacagtcattgatgcccccggtcataaggattttatcaaaaatatgattacgggtacgtcgcaggctgatgtggctctcttggttgttcctgctgaggttggtggttttgaaggtgccttttcaaaggaaggtcaaactaaggaacacgccttgttagccttcaccctcggtgtgaaacagatcgttgttggtgtcaacaagatggacactgtgaaatactcagaagatagatacgaagaaattaagaaggaagttagggattacctgaaaaaggtcggataccaagctgacaaggttgactttatccccatttctggatttgaaggtgataacctgattgagaagtcagacaagaccccatggtataaaggaaggaccttgatcgaggctttggacactatggaaccacccaagagaccatacgacaaacctttaagaattccactccaaggtgtgtacaaaattggtggtattggtaccgtgcccgttggcagagtcgaaactggtattttgaaggccggtatggttctcaactttgccccatctgctgtcgtttcggagtgtaaatccgtcgaaatgcacaaagaagttttggaagaggcaagaccaggtgacaacatcggatttaacgtaaagaacgtttctgttaaagaaatcaagagaggatatgtcgcttctgataccaagaatgagccagccaagggatgctccaaatttactgcccaggttatcattttgaaccatcctggagaaattaagaacggatacagtcccgtcctagattgccacactgctcacatttcttgcaaatttttgaacatcgactcgaagattgacaagcgttctggtaaggtcgttgaggaaaaccctaaatcaattaagtctggtgattcagccttggttagtctcgagccaaagaagcctatggttgttgagaccttcactgagtatccacccctaggaagatttgctattcgagatatgagacaaaccatcgctgtcggtatcatcaaggcggtcgaaaagaaggagccaggtgccgtgtccgctaaaaacccagcgaagaaa

SEQ ID NO: 40 - protein, 20 aa, Plasmodium yoelii
  MISC_FEATURE (8)..(8): X is a threonine (T) residue or a serine (S) residue
GKVAIILXGKHMGKRCIITK

SEQ ID NO: 41 - protein, 26 aa, Plasmodium yoelii
  MISC_FEATURE (13)..(13): X is an isoleucine (I) residue, a valine (V) residue, an asparagine (N) residue, or a threonine (T) residue
  MISC_FEATURE (15)..(15): X is an isoleucine (I) residue, a valine (V) residue, an asparagine (N) residue, or a threonine (T) residue
GKHMGKRCIITKXLXSGLLAVVGPYE

SEQ ID NO: 42 - protein, 20 aa, Plasmodium yoelii
  MISC_FEATURE (12)..(12): X is a valine (V) residue or an isoleucine (I) residue
SGLLAVVGPYEXNGVPLKRV

SEQ ID NO: 43 - protein, 20 aa, Plasmodium falciparum
GKVAIILTGKHMGKRCIITK

SEQ ID NO: 44 - protein, 20 aa, Plasmodium vivax
GKVAIILSGKHMGKRCIITK

SEQ ID NO: 45 - protein, 26 aa, Plasmodium yoelii
GKHMGKRCIITKILNSGLLAVVGPYE

SEQ ID NO: 46 - protein, 26 aa, Plasmodium vivax
GKHMGKRCIITKVLTSGLLAVVGPYE

SEQ ID NO: 47 - protein, 20 aa, Plasmodium yoelii
SGLLAVVGPYEVNGVPLKRV

SEQ ID NO: 48 - protein, 20 aa, Plasmodium falciparum
SGLLAVVGPYEINGVPLKRV

SEQ ID NO: 49 - protein, 234 aa, Plasmodium yoelii
MAKNNKNTKSVVSSDDKKSLLKHYVIKGQHKILTPIQAKKTISKKHYGRKIASKKKYIVQRKMRKSIQIGKVAIILTGKHMGKRCIITKILNSGLLAVVGPYEVNGVPLKRVDPRYLIVTSTNVFDLNNLSQIKDKFIQTAEDIHDDIFIKSNDIKKRQKKLLKNKNESLFMNDVIQQIKEIRDSDPKMKKIKSLQKQLGDLLKPEMSKDKMLRSYLKSKFTLRNNMSFHTIKF

SEQ ID NO: 50 - protein, 221 aa, Plasmodium falciparum
MTNTSNELKHYNVKGKKKVLVPVNAKKTINKKYFGRKVASKKKYVVQRKLRKSIEVGKVAIILTGKHMGKRCIITKILNSGLLAVVGPYEINGVPLKRVDSRYLVVTSTNIFNFENIAKLKDDFLNYAQDIDDDSFIKTLEIKKKQKKLLKNKNEALFMNNVIDKIKEIRKEDPKVQKLEGIQKDIGSLLKPEILKNKVFAHYLKSKFTLRNDMVLHKMKF

SEQ ID NO: 51 - protein, 231 aa, Plasmodium vivax
MAKDNKGKVKKAAGEETVKYYRVKGKKKILIPVKAKKTIAKKYYGRKLASKKKYIVQGKMRKSIEVGKVAIILSGKHMGKRCIITKVLTSGLLAVVGPYEVNGVPLKRVNPRYVVVTSTNIFKFENMAGLKDEFVKLAEQIEDNSFVKSLEIKKKQKKLLSKKNEGLFMNDVITKIKELMKEDPKMQQLQKIQKEIGTLLKDEIAKNKIFAEYLKSKFTLRNDMALHKMKF

SEQ ID NO: 52 - DNA, 702 bp, Plasmodium yoelii
atggctaagaataacaaaaatacaaaaagtgtggtatcatctgatgataaaaaaagccttttaaaacattatgtaataaaagggcaacacaaaattcttaccccaatacaagcaaaaaaaacaatttctaaaaaacactatggaagaaaaatagcatcaaaaaaaaaatatattgtacaaaggaaaatgagaaaatctatccaaattggaaaagtagcaattatattaacaggaaaacatatgggtaaaagatgtataataactaaaattttaaattcaggattattagcagtggttggaccatatgaagttaatggggtacctttaaaaagagtagatccaagatatttgatagtaacatctacaaatgtttttgatttaaataatttatcacaaattaaagataaatttattcaaactgctgaagatatacatgatgatatttttataaaatctaatgatattaaaaaaaggcaaaaaaaattattaaaaaataaaaatgaatctctttttatgaatgatgttatacaacaaattaaagaaatacgagattctgatccaaaaatgaaaaaaataaaatcattacaaaaacaattaggagatttattaaaaccagaaatgtcaaaagataaaatgttaagatcatatctaaaatcaaaattcactttacgaaataatatgtcttttcatactattaaattt

SEQ ID NO: 53 - DNA, 663 bp, Plasmodium falciparum
atgacaaacacaagcaacgaattaaagcactataatgtgaaaggaaagaaaaaagttttagtaccggtaaatgcaaaaaaaaccattaacaagaaatacttcggaaggaaagttgcttccaaaaagaaatatgttgtacaaagaaaattaaggaaatctatagaagtaggaaaggtagccatcatattaacaggaaaacatatgggtaagagatgtataataaccaaaattttaaattcaggattattagctgtagtaggtccatatgaaattaatggggttcctttaaaaagagttgattcaagatatttagttgttacatctactaatatttttaactttgaaaatatagccaagttaaaagatgacttccttaactatgctcaagatattgatgatgattcttttattaaaaccttagaaattaaaaaaaaacaaaagaaactcttaaaaaataaaaatgaagccctctttatgaataatgttattgacaaaattaaagaaatcagaaaagaagatccaaaggttcagaaattagaaggtatacaaaaagatattggaagtttgttaaaaccagaaattttaaaaaataaagtcttcgctcattacttaaaatctaaatttaccttaagaaatgatatggttttacacaaaatgaagttt

SEQ ID NO: 54 - DNA, 693 bp, Plasmodium vivax
atggcgaaggacaacaagggaaaggtgaagaaggccgcgggcgaagaaacagtcaagtactacagagtgaagggcaagaaaaaaattttaatcccagttaaggccaagaaaaccattgcgaagaaatactatggaaggaaattagcgtcaaagaagaaatacattgtgcaggggaaaatgagaaagtcgatcgaagttggaaaagttgcaattatattgtcaggcaaacacatgggaaagagatgcataattacgaaggtattaacctcagggctgttagctgtcgtaggtccgtatgaagtaaacggggtccctttaaagagagttaacccacgatacgtcgtagtgacatccacgaacatttttaaatttgaaaatatggcagggctgaaggatgaatttgtcaaactggccgaacagatcgaagataattcttttgttaaatctttggaaataaaaaaaaagcaaaagaaacttctcagcaaaaagaatgaaggcctcttcatgaatgacgtgattaccaaaattaaggagttgatgaaggaggaccccaagatgcagcagttgcaaaaaatccagaaggaaattggcaccctactgaaggatgaaattgccaagaacaaaatctttgcagagtatttgaagtccaaatttacactgcgaaacgatatggctctgcacaaaatgaagttc

SEQ ID NO: 55 - protein, 24 aa, Plasmodium yoelii
LEKKMQLKKEGKLLSAKAKEEKKK

SEQ ID NO: 56 - protein, 44 aa, Plasmodium yoelii
IVCILGHVDTGKTKLLDKLRHTNVQDNEAGGITQQIGATFFPKD

SEQ ID NO: 57 - protein, 70 aa, Plasmodium yoelii
SKGIMIIDTPGHESFYNLRKRGSSLCDIAILVIDLMHGLEQQTKESIQILKQRNCPFVIALNKIDRLYMW

SEQ ID NO: 58 - protein, 26 aa, Plasmodium yoelii
KLECTVLEVKNIEGLGTTIDVILTNG

SEQ ID NO: 59 - protein, 21 aa, Plasmodium yoelii
GVGLYVMASTLGSLEALLIFL

SEQ ID NO: 60 - protein, 35 aa, Plasmodium yoelii
  MISC_FEATURE (14)..(14): X is a serine (S) residue or a threonine (T) residue
MTDVSDVFNHVDKXGVGLYVMASTLGSLEALLIFL

SEQ ID NO: 61 - protein, 35 aa, Plasmodium yoelii
MTDVSDVFNHVDKSGVGLYVMASTLGSLEALLIFL

SEQ ID NO: 62 - protein, 35 aa, Plasmodium falciparum
MTDVSDVFNHVDKTGVGLYVMASTLGSLEALLIFL

SEQ ID NO: 63 - protein, 938 aa, Plasmodium yoelii
MSKNKKGKKKEDLDAILAELGIEEKREDQINENEGGEEKAENTQISKSKKRKEKLKQKKEQIKLKENDDTPIAQTEAVKEEDAKDGEKDGEKDGEQDGENNEAAKGKKKKKKKKEKESKAETGISAAAKAAAERLRLLKEFEEKQKEEERKKREEEEERIRKEEEEKEKKRLARLEKKMQLKKEGKLLSAKAKEEKKKRELYLQTLKESGMLIEPKEKAKAEIINLDINKAKLLLKKKKNKQISSGINNQNSDDKNKDDENKEDKNKDNENKEEEKEIVLDDWEDFLNMDNEEKKKTEKNDIDQNTKENKQTQIVKKSSINDKKGKKQKNNKNGEYNEDKDNEKTKDEEDIYRSSIVCILGHVDTGKTKLLDKLRHTNVQDNEAGGITQQIGATFFPKDVLDKEIKKIDKTIKCLSKGIMIIDTPGHESFYNLRKRGSSLCDIAILVIDLMHGLEQQTKESIQILKQRNCPFVIALNKIDRLYMWEKNDWEPFNDTFKNQKEYVKEEFKNRLQTILNELSEQGLNCQLYWENKNPRKFVSIVPTSAITGEGIADLIMVLVKLTQSFMLKNIEYNNKLECTVLEVKNIEGLGTTIDVILTNGVLKESDTLVLCGMNGPIVTVARALLTPQPLKELRIKNEYIHHKSIKACIGVKISANGLEEVLCGTSLFVANNNDEIEEYKKKVMTDVSDVFNHVDKSGVGLYVMASTLGSLEALLIFLNDSKIPVFSVNIGTVQKKDVKKASIMREKGKPEYAVILAFDVKIDPEAEKEAQILGVEIMQKDIIYHLFDAFTAYLKKIEDEKKQSKMADAIFPCEVSIINDCVFNKKDPIVVGVKIEAGILKIGTPLYIPEKNLKIGNVVSIESNKKSCNKAKKGEEVCVKIAGEPNVTYGRHFDFNQKIYSKITRESIDVLKQYFRNELTMDDWRLVVHLKKILNIL

SEQ ID NO: 64 - protein, 977 aa, Plasmodium falciparum
MSKNKKGKKKEDLDAILAELGIEEKREDDVKANENEENEPTKMSKSKKKKEKLKQKKEQMKNKEDDEKDDQKGIDGEKDTDQKKDQDDQKDDDNQNEADNQNEADNQNEGENQKKKKNKKKKDKEKKAGGAAGAATGGMSEIAKAAAERLRLLKEYEEKKKEEERLKKEEEEERIRKEEEEKEKKRIAKLEKKMQLKKEGKLLSAKAKEEKKKNEIYLKQLKESGMLIEPREKSKSEYINLDINKTKLLLKKKKTKSIMVPTSSNNNNLNDDDKNNKQMLSNSSLKLNEEDELQGSQKVDEKDIVLDNWEDFLHIDEAKKKEQEEIERKEKERKEKEKEEREKERKSVINNSSSSINYGRKSFHIKNDILMRKGNKKKIDNELDDDDNNEYRSAIVCILGHVDTGKTKLLDKLRHTNVQDNEAGGITQQIGATFFPKDVLDKEIKKIDDTIKCLSKGIMIIDTPGHESFYNLRKRGSSLCDIAILVIDLMHGLEQQTKESIQILKQRNCPFVIALNKIDRLYMWNKNDWSPFNNTFKKQKPDTQEEFHDRLKNIINELSEQGLNCQLYWENMNPRKYVSIVPTSAITGEGIADLIMVLVKLTQTFMLKNIQYHDKLECTVLEVKNIEGLGTTIDVILTNGILRESDTIVLCGINGPIVTVIRALLTPQPLKELRIKNEYIHHKYIKACIGVKISANNLEEVLCGTSLFVVNNIEEEEEYKKKVMTDVSDVFNHVDKTGVGLYVMASTLGSLEALLIFLNDSKIPVFGVNIGTIQKKDVKKASIMREKGRPEYAVILAFDVKIDPEAEKEAALLGVEIMQRDIIYHLFDSFTAYLKKIEEEKKQSKITDAIFPCELSVINDCVFNKKDPIVIGVRVECGQLKIGTPLFVPEKNIKIGNVVSVQSNKKNFDKARKGDEVCIKICGEPHVTYGKHFDSTQKIYSKITRESIDVLKEYFRSELTMEDWKLVVQLKKIFNIV

SEQ ID NO: 65 - protein, 1006 aa, Plasmodium vivax
MSKNKKGKKKDDLDAILAEFGIDEKREDEVKEQKEEAGQAGGGGVSGVVSGVAPAGAEENEAAKMSKSKKKKEKLKQKKEQMKGKENEEEGEGGEAKKGPGEQPPGAAADEAVDAVDANDANEDAKKNKKKKKKEKEKANEKKGTSGMSEMAKAAAERLRLLKEYEEKKREEERRKQEEEEERIRKEEEEKEKKRLAKLEKKMQLKKEGKLLSAKAKEEKKKKELYLKTLKESGVLVEPKEKTKAEIISIDLNKTKAFLKKKKNKTNANANVGAGANLNNNAEGGGGTTPQGGKLDESLGQDGAEKKVDPKEIVLDDWEDFLNVDEEGKKEKQPSEQKSGEKADRERNKSKEGKAAEGKAAEGKAAEGKAAEGKAADGKKSPKGEAPSAKKGKKKTDAGKSSGGEKNSHAQGESDGESEYRSAIVCILGHVDTGKTKLLDKLRHTNVQDNEAGGITQQIGATFFPKDILDKQIKKVDESIKCMSKGIMIIDTPGHESFYNLRKRGSSLCDIAILVIDLMHGLEQQTKESIQILKQRNCPFVIALNKIDRLYMWSKSDWSPFNYTFQNQKENTQEEFQDRLKNILNELAEQGLNCHLYWENPNPRKYVSIVPTSAITGEGIADLIMILVKLTQNFMLKNIEYHEKLECTVLEVKNIEGLGTTIDVILTNGVLKESDTIVLCGINGPIVTVIRALLTPQPLKELRIKNEYVHHKSIKACIGVKISANGLEEVLCGTSLFVANNTNEIEDYKKKAMTDVSDVFNHVDKTGVGLYVMASTLGSLEALLIFLKDSKIPVFAVNIGTVQKKDVKKASVMREKGKPEYSVILAFDVKIDPEAEKEAQILGVEIMQKDIIYHLFDAFTSYIKKIEEEKKQSKLTDAIFPCELSIVNDCVFNKKDPIVIGVKVDCGILKIGTPLYIPEKSLKIGNVVSILLNKKTCEKAKKGDEVSIKICGEPHITFGRHFDFNQKIYSKITRESIDVLKEYFRSELTMEDWRLVVQLKKIFNII

SEQ ID NO: 66 - DNA, 2814 bp, Plasmodium yoelii
atgagcaaaaataaaaaaggaaaaaagaaggaagatttagatgctattttagcagaattaggaattgaagaaaaaagagaagatcaaattaatgaaaatgaaggaggagaagaaaaagctgaaaatacacaaatatcaaaatcaaaaaaaagaaaagaaaaattaaaacaaaaaaaagaacaaataaaattaaaagaaaatgatgatacaccaatagcacaaacagaagctgttaaagaagaagatgcgaaagatggcgaaaaagatggcgaaaaagatggagaacaagatggtgaaaataatgaagcagctaaagggaaaaaaaaaaaaaaaaaaaaaaaagagaaagaatcaaaagcagaaactggtatatcagcagcagcaaaagcagctgctgaaagattaaggcttctaaaagaatttgaggaaaaacaaaaagaagaagaacgaaaaaaaagagaagaagaagaggaacgaattagaaaagaagaagaagaaaaagaaaaaaaaagattagcaagattagaaaaaaaaatgcaattaaaaaaagaaggaaaattattaagtgcaaaagctaaagaagaaaaaaaaaaaagagaattatatttacaaacattaaaagaatcaggaatgttaatagaacctaaagaaaaagcaaaagcagaaattataaatctagatataaataaagctaagttattattaaaaaaaaaaaaaaataaacaaatatcaagcggtataaataatcaaaatagtgatgataaaaataaagatgacgaaaataaagaagacaaaaataaagataacgaaaataaagaagaagaaaaagaaatcgttttagatgattgggaagattttttaaatatggataatgaagaaaaaaaaaaaacagaaaaaaatgatatcgatcaaaacacaaaagaaaataaacaaactcagattgtgaaaaaaagttctataaatgataaaaaaggaaaaaaacaaaaaaataataaaaatggagaatataatgaagataaagataatgaaaaaacaaaagatgaagaagatatatatcgatcatctattgtttgtattcttggtcatgtagatacaggaaaaacgaaattattagataaacttagacacacgaatgtacaagataatgaagcaggaggtattactcaacaaattggagcaacattttttccaaaagatgttttagataaagaaataaaaaaaatagataaaacaattaaatgtttatcaaaaggtattatgattatagatacaccaggtcatgaatctttttataatttaagaaaaagaggatcttctttatgtgatattgcaatattagttattgatctaatgcatgggttagaacaacaaacaaaagaatctattcaaattttgaaacaaagaaattgtccatttgtaattgcattaaataaaatagatagattatatatgtgggaaaaaaatgattgggaaccttttaatgatacatttaaaaatcaaaaagaatatgtaaaagaagagtttaagaatagattacaaactatattaaatgaattatcagaacaaggattaaattgtcaattatattgggaaaataaaaatccgagaaaatttgtatctatagttccgaccagtgctataacaggggaaggtatagcagatctaattatggtcttagttaaattaactcaaagttttatgttaaaaaatattgaatataataataaattagaatgtactgttttagaagttaaaaatattgaaggtttaggaacaacaatagatgtaatattaacaaatggggtcttaaaagaatcagatactcttgttttatgtggaatgaatggtcctatagtaacagtagctagagcattgttaactccccaacctttaaaagagttaagaataaaaaatgaatatattcatcataaaagtattaaagcatgtattggagttaaaatatcagcaaatggtttggaagaggttttatgtggtacatctttatttgtagctaataataatgatgaaatcgaagaatataaaaaaaaagttatgacagatgtatcagatgtttttaatcatgttgataaatccggtgttggtttatatgttatggctagtacattaggttctttagaagctttacttatatttttaaatgattccaaaattcctgttttttcagtaaatattggaactgttcaaaaaaaagatgtaaaaaaagctagtattatgagagaaaaaggaaaaccagaatatgcagttatattagcatttgatgttaaaatagatccagaagcagaaaaagaagcacaaatattaggtgttgaaattatgcaaaaagatattatatatcatttatttgatgcatttactgcttatttaaaaaaaatagaagatgaaaaaaaacaaagtaaaatggctgatgctatttttccatgtgaagtatctattataaatgattgtgtatttaataaaaaagatcctatagttgtaggtgttaagattgaagctggaattttaaaaataggtacccctttatatataccagaaaaaaacttaaaaattggaaacgttgtaagtattgaatcaaataaaaaaagttgtaataaagcaaaaaaaggtgaagaagtttgtgtaaaaatagctggtgaaccaaatgttacatatggacgtcattttgattttaaccaaaaaatatacagtaaaattacgagagaaagtattgatgttttaaaacaatatttcagaaatgaacttacaatggatgattggcgattagttgtgcatcttaaaaaaattctgaacatttta

SEQ ID NO: 67 - DNA, 2931 bp, Plasmodium falciparum
atgagtaaaaataaaaagggaaaaaagaaggaagatctcgatgctattctggccgaattaggaatagaagaaaaaagagaagatgacgtaaaagcaaatgaaaacgaggaaaatgaacctaccaaaatgtccaagtccaaaaagaaaaaggaaaaactcaaacaaaaaaaagaacaaatgaaaaataaagaagatgatgagaaggatgatcaaaaaggtatagatggtgaaaaagatacagaccaaaaaaaagatcaggatgaccaaaaagatgatgataaccaaaatgaagcggataaccaaaatgaagcagataatcaaaatgaaggtgaaaaccaaaaaaagaaaaaaaacaaaaagaaaaaagataaagaaaaaaaagctggtggagcagcaggagcagctacaggggggatgtctgaaatcgctaaagcagctgctgaaagattaaggttattaaaagaatatgaagaaaaaaagaaagaagaagaaagattgaaaaaagaagaagaagaagaaagaattagaaaagaagaagaagaaaaagaaaaaaaaagaattgcgaaattagaaaaaaaaatgcaattaaaaaaagaaggtaaattattaagtgctaaagctaaagaagaaaaaaaaaaaaatgaaatatatttaaaacaattaaaagaatcaggtatgctaatagaaccaagagaaaaaagcaaatctgaatatataaatctagatataaataaaaccaaattattattaaaaaagaaaaaaaccaaatcaataatggtacccacatcatcaaataataataatctaaatgatgatgataaaaataataaacaaatgttatcaaatagtagccttaaattaaacgaagaagatgaattacagggttctcaaaaagtagatgaaaaagatattgtactcgacaattgggaagattttttacatattgatgaagcaaaaaaaaaggaacaagaagaaattgaaagaaaagaaaaagaaagaaaagaaaaagaaaaagaagaaagagaaaaggaaaggaagtctgttataaataatagtagtagtagtataaattatggtaggaaaagttttcatattaaaaatgatatattaatgagaaaaggaaataagaaaaaaatcgataatgaattagatgatgatgataataatgaatatagatctgctattgtttgtatattaggtcatgtagatacagggaaaacaaaattattagataagttaagacatacaaatgttcaagataatgaagctggtggtataacacaacaaattggagcaacattttttccaaaagatgtattagataaagaaataaaaaaaattgatgatacaattaaatgtttatcaaaaggtattatgataatagatacacctggacatgaatccttttataatttaagaaaacgaggttcatccttatgtgacatagctatcttggttatagatttaatgcatggtttagaacaacaaacaaaagaatctattcaaatattaaaacaaagaaattgtccatttgttatagcattaaataaaatagacagattatatatgtggaataaaaatgattggtcaccatttaataatacttttaaaaaacaaaaaccagatacacaagaagaatttcatgatagattgaaaaatataattaatgaattatcagaacaaggtttaaattgtcaattatattgggaaaatatgaacccaagaaaatatgtatccatagtacctactagcgcaataacaggtgaaggtatagcagatttaattatggtgttagtaaagttaacacaaacatttatgttaaaaaatatacaatatcatgataaattagaatgtactgtattagaagtaaaaaatattgaaggtttaggaacaacaatagatgttatcttgacaaatggtatattaagagaatctgataccattgttttgtgtggaatcaatggacccatagtaaccgtgattagagcattgttaacaccacaacctttaaaagaattaagaattaaaaatgaatatatacatcataaatatattaaggcatgtataggagtaaaaatatcagcaaataatttagaagaagtcttatgtggtacatcattatttgttgtaaataatatagaagaagaagaagaatataaaaagaaagtaatgacagatgtatctgatgtatttaatcatgtagataaaacaggtgtaggtttatatgttatggctagtactttaggttcattagaagcattattaatttttctaaatgattccaaaattccagtatttggagtaaatataggaactattcaaaaaaaagatgtaaaaaaagctagtatcatgagagaaaaaggaagacctgaatatgctgtaatattagcctttgatgtaaaaatagatccagaggcagaaaaagaagcagctcttttaggtgtagaaattatgcaaagagatatcatctatcatctcttcgattcatttactgcatatctaaaaaaaatagaagaagagaaaaaacaaagcaaaattacagatgctatattcccttgtgaactttcagttataaatgattgtgtatttaacaaaaaagatccaatcgttataggagtaagagtagaatgtggtcaactcaaaataggaacacccctttttgtaccagaaaaaaatattaaaataggtaatgtagtaagtgttcaaagtaataaaaaaaatttcgataaagccagaaaaggagatgaagtatgtattaaaatttgtggggaaccacatgtaacatatggtaaacattttgattcaacacaaaaaatttatagtaaaattacaagagaaagtatagatgttctgaaagaatattttagaagcgagttaacaatggaagattggaagctcgtagtacagctcaaaaaaatatttaacattgta

SEQ ID NO: 68 - DNA, 3018 bp, Plasmodium vivax
atgagcaaaaataaaaaggggaagaagaaggacgacttggatgcgatcctcgccgaattcggcatcgacgagaagcgggaggatgaagtgaaggagcagaaggaagaggcgggacaagcgggtggcggaggagtcagcggcgtggtcagcggagtggcccctgccggggcggaggaaaacgaggcggccaaaatgtccaagtcgaaaaagaaaaaggaaaagctgaagcagaagaaggagcaaatgaagggcaaggagaatgaggaggagggagagggcggggaggcgaagaagggaccgggcgagcagccccccggtgccgccgcggatgaagcggtcgacgcggtggacgcgaatgacgcgaatgaggacgccaaaaagaacaaaaagaagaagaagaaggaaaaggagaaggccaacgaaaagaaaggcacctcggggatgtccgaaatggccaaggcagccgcggagagactcaggctgctaaaagaatacgaggaaaaaaaaagagaagaagaaaggaggaagcaagaagaggaagaagaaagaattagaaaggaggaggaagagaaggaaaaaaaacgactagccaaattggaaaaaaaaatgcagctaaaaaaggagggcaaactgctaagcgcaaaggcgaaagaagaaaaaaaaaaaaaagaattgtatttgaaaacgctgaaggagtccggggtgctggtcgagccgaaggaaaagaccaaagcggagatcatcagcatcgatttgaacaaaacgaaggccttcctgaagaagaagaagaacaaaacgaatgctaatgcgaacgtgggcgcgggtgccaacttgaataacaacgcggagggggggggaggcacaaccccccaggggggcaagctggacgagtcgctgggccaggacggcgcggaaaagaaagtggaccccaaggaaattgtcctggacgactgggaagacttcctcaacgtggatgaggagggcaaaaaggaaaaacagcccagtgagcagaagagtggcgagaaggccgacagggaaaggaacaaatcgaaggaggggaaagcggcggaggggaaagcggcggaggggaaagcggcggaggggaaagcggcagaggggaaagcggcggacgggaagaaatcccccaagggggaggcgcctagcgccaagaaggggaaaaaaaaaacggatgcgggcaaaagcagcggcggcgaaaaaaacagccacgcgcagggtgagtcagacggcgagagcgagtaccggtcagccatcgtgtgcatattggggcatgtggacacggggaaaacgaagctgctggacaagctgcgacataccaatgtgcaggataacgaggcgggaggaattacgcagcaaatcggagcgaccttcttcccaaaggatatcctcgacaagcaaataaaaaaagtggacgaaagcatcaagtgcatgtcgaagggaattatgattatagacactccggggcatgaatccttctacaatctgaggaagagaggctcctccctgtgcgatatagccattttggtgattgacctgatgcacggcctcgagcagcagacgaaggagtccatccaaattctaaagcagaggaactgccccttcgttattgcgctgaacaaaattgataggctctacatgtggagcaaaagtgactggtccccattcaactacacatttcaaaatcaaaaggaaaacacacaggaggagttccaggatagactgaagaatatccttaacgagctagccgagcaagggttgaactgtcacctctattgggaaaaccccaacccgaggaaatacgtttccattgtacccactagtgcaataacgggggagggtattgcggacctcatcatgattttagtaaaattgacccaaaattttatgcttaaaaatattgaataccacgagaaattagagtgcaccgttttggaagtaaaaaacattgaagggttaggcaccaccatcgatgttattctaaccaatggggtgctcaaagagtccgacacgattgtcctatgtggtatcaacggaccgatcgtgactgtcattagggccctcctaactccgcaacctctaaaagagttaagaataaaaaatgagtatgtgcatcacaaatctattaaggcatgcattggtgtaaaaatctctgccaatggattggaagaggtcctctgtggtacttccctattcgttgccaataatacaaacgaaattgaagactacaaaaagaaagcaatgaccgacgtttcggatgtgttcaatcacgtagataagacaggggtaggtctctacgtcatggctagcactcttggctcgttagaagcactactcatttttttaaaagattctaagatccccgtttttgctgtgaacatcgggacggtgcaaaagaaagacgtcaagaaagccagcgtcatgagggaaaaggggaaacccgaatactcagtcatcctagcctttgatgtaaaaatcgatccggaggcagaaaaggaagcgcaaattttaggagtggaaatcatgcagaaggatatcatttaccacctatttgatgccttcaccagttatattaaaaaaattgaagaggagaaaaaacagagcaaattgactgatgcaattttcccatgcgaactctccattgtgaacgactgcgtgtttaataagaaggatcccatcgtcattggggttaaggtagattgtggtattttaaaaattgggaccccactgtacatcccagagaagagcctaaaaataggcaacgtggttagcatcctcctgaacaagaaaacctgtgaaaaagccaaaaagggggacgaagtttccattaagatttgcggagaaccccacatcaccttcggaaggcacttcgactttaaccaaaagatttacagcaaaattaccagagagagcatcgacgtgttgaaggagtacttcaggagcgaactcaccatggaggactggcggctcgtcgtgcagctcaagaagatcttcaacatcatc

SEQ ID NO: 69 - protein, 21 aa, Plasmodium yoelii
NLFFAKQVIPNACATQAILSI

SEQ ID NO: 70 - protein, 22 aa, Plasmodium yoelii
  MISC_FEATURE (5)..(5): X is an S residue, a T residue, or an N residue
  MISC_FEATURE (15)..(15): X is an S residue, a T residue, or an N residue
NFDSXMKGLTLSNCXFLRNIHN

SEQ ID NO: 71 - protein, 22 aa, Plasmodium yoelii
NFDSTMKGLTLSNCNFLRNIHN

SEQ ID NO: 72 - protein, 22 aa, Plasmodium falciparum
NFDSSMKGLTLSNCTFLRNIHN

SEQ ID NO: 73 - protein, 22 aa, Plasmodium vivax
NFDSSMKGLTLSNCNFLRNIHN

SEQ ID NO: 74 - protein, 419 aa, Plasmodium yoelii
MQSENDSIGEWCLIESNPCIFYEMLKQMGAKNLSAEDVYDLDHFDNYINNKDEIKIEHILSIQEYRSEKEKEAGLKSKMETEPYNSDIDLEDKYNKLLNNFSHVFGIIFLFNIGKSYDRKKYKEHNIPENLFFAKQVIPNACATQAILSIIFNKNIKLNENIENIKTFSINFDSTMKGLTLSNCNFLRNIHNSFKTPVYIENDDLYHNKKKESNSFHFVSYIEFEKNVYLLDGLQEGPILITDKNDDEKKEIENNWINIARNHIKKDINIMSNSEDDTENRFNILAIIKDKECIINEYINIHRIFKQRISVKLISLGENIEFDDEINEDDYYFSNKIPSIDQLTSNIEKLHNILKKSSNEINFLENLLTKEIELKASWDKERTFKFYNFYPFIISSIDLMAKHKILKPSYEKEKQKRNN

SEQ ID NO: 75 - protein, 465 aa, Plasmodium falciparum
MARDNENILEEWCLIESNPCIFYDMLKRMGATEISVEDVYSLSYFDDYINNKEIINMNHILGVDTYLGENNKTLDKENNVVDVIELYKNNICMEDKYNKLLKHHSYIYGIIFLFNIGKHYKNNKYIEHNVPDNLFFAKQVIPNACATQAILSIVLNKDIELNDEIKNIKTFSLNFDSSMKGLTLSNCTFLRNIHNSYKPPIYLDKEDVHHDKKKSEDSFHFVSYISFQDKVYLLDGLQSGPVLINADEQNKPNPNNNNNNKDNDNDNNNNNNNNNNNNNNNNNNNNNNNNNNIGMNGKDWIEISREHIKKEIDEICNSQTNNDVRFNIIAVMKDKEYIIQEYINIHRIVKQRVNIKLINLGENIELSDEINEDEFPLLNDIPSIENLPNNVDTLYNIVNKSTLEINYLQSLLHEQKEIKKLWNKELTFKFFNFYPFIMSSLNLMAKHKLLKDAYQKEKLKNATKS

SEQ ID NO: 76 - protein, 506 aa, Plasmodium vivax
MQRSSNEGLSEWCLIESNPCIFNDMLSRMGAKHLSVEDVYDLEFFDDYIYNRDVVSVEHVLSIELYKTEKEKEKEREEREEQKEREEREEQKEQNAADGSTGGGAPPKREMYRNTAETDEKYYRLIRNENSIFGIIFLFNIGKSYKRNKFVEHSVPENLFFAKQVIPNACATQAILSIVLNIGVELNEEIKNIKSFSNNFDSSMKGLTLSNCNFLRNIHNTYKPPIYIEKENLHDEKGKNNDSFHFVSYIQFGGSVYMLDGLQEGPVLIGQTGGADGRRSWVDLAREHIKKEIDEICGVSGGSGVSGGVGGSSGGRGGSGGGDGRFNILIVVKDKEYLLKEFYKIHRILYKRLFTKLRSLGVKEELLLDPVHDKINDQLSEEISAEMNGQVSGQANGQANGQANVQANGQVIEEKFNYANIPTVEELPDNIGELLTTFHKSQFEINYLQALLQEQKQLKRSSKKELAFKYFNFYPFVMSSLKLMAKHKFLKEAYQKQKQKRRRAIA

SEQ ID NO: 77 - DNA, 1257 bp, Plasmodium yoelii
atgcaaagtgaaaatgatagcattggggaatggtgcttaattgagagtaatccctgcatattttatgagatgttaaaacagatgggagcaaaaaatttatcagcagaagatgtatatgatttagatcattttgataattatataaataataaagatgaaataaaaattgaacatatattaagcatacaagaatacagaagtgaaaaagaaaaagaagcaggtttaaagtcaaaaatggaaacagaaccatataatagtgacatagatttagaagataaatataataagcttttaaataatttttctcatgtatttggaataatatttttatttaatattggaaaaagttatgatcgaaaaaaatataaagaacataatattcctgaaaatttattttttgctaaacaagtcattccgaatgcatgtgcaacacaagctatattatctattatatttaataaaaatataaaattaaatgaaaatatagaaaatataaaaacgtttagtataaattttgatagtactatgaaagggttaacattatctaattgtaattttttacgaaatattcataattcttttaaaacgccagtatatatagaaaatgatgatttatatcataacaaaaaaaaagaatcaaattcttttcattttgtatcatatattgaatttgaaaaaaatgtatatttattagatgggttacaagaaggcccaatattaattactgataaaaatgatgatgaaaaaaaagaaatagaaaataactggataaatatagcacgaaatcatataaaaaaagatataaacattatgagcaatagtgaagatgatacagaaaatcgatttaatattttggcaataataaaagataaggaatgtataattaatgaatatataaatatacatagaatatttaaacaaagaataagtgttaaactaataagtttaggagaaaatatagaattcgatgatgaaataaatgaagatgattattatttttctaataaaatacctagtattgatcaacttacatctaatattgaaaaattacataatattttaaaaaaatcatctaatgaaattaattttttagaaaatcttttgactaaagaaatagaacttaaagcttcttgggataaagaacgaacttttaaattttataatttttaccctttcataatatcttcaatcgatttaatggctaaacataaaatcttgaaaccgtcttacgaaaaagaaaaacaaaaacgaaataat

SEQ ID NO: 78 - DNA, 1395 bp, Plasmodium falciparum
atggcgagggataatgaaaacattttagaagagtggtgtttaatagaaagtaacccgtgtatattttatgatatgcttaaacgtatgggtgctacagaaatttcagtagaagatgtgtatagtttatcttattttgatgattatataaataataaggagattataaatatgaatcatatattgggtgttgatacatatttaggagaaaataataaaacgctggataaagagaataatgttgttgatgttatcgaattatataagaataatatatgtatggaagataaatataataaattattaaaacatcatagttatatttatggtataatatttttatttaatattggaaagcattataaaaataataaatatattgagcataatgttcctgataatttattttttgctaaacaagttataccaaatgcatgtgctacacaagctattttgtctattgtgttgaataaggatatagaattaaatgatgaaataaaaaatataaaaacatttagtttaaatttcgatagttcaatgaaaggattaacattatcaaattgtacttttcttcgtaatatacataattcatataaacctccaatatatttagataaagaggatgtacatcatgataaaaaaaaaagtgaagactcctttcattttgtttcctatattagttttcaggataaagtatatttattggatggtttacaaagtggccccgtgcttataaatgcagacgagcaaaataaacccaacccaaacaataacaacaataataaggataatgataatgataataataacaacaataacaataataataacaataacaacaataacaacaataacaacaataacaataataataacaatattgggatgaatggaaaagattggatagaaatttctagagaacatataaaaaaagaaatagatgaaatatgtaattcacaaactaataatgatgttcgttttaacattattgccgttatgaaagataaagaatacattattcaagaatatataaatatacatcgcatagttaaacaaagagttaatatcaaattaattaaccttggagaaaatattgaactatcagatgaaattaatgaagacgaatttcccttattaaacgatataccctcaatagaaaacctaccaaacaatgtagatactttatataatatagtaaataaatcaaccttagaaattaactatttacaatcattattacatgagcaaaaagaaataaaaaaattatggaataaagaactgacttttaaattttttaatttctatcctttcataatgtcttctcttaatttaatggctaagcataagttattaaaagatgcttatcaaaaagaaaaattaaaaaatgcaacaaaatct

SEQ ID NO: 79 - DNA, 1518 bp, Plasmodium vivax
atgcaacgaagcagcaacgagggcctgagcgaatggtgcctgatcgagagcaacccctgcatcttcaacgacatgctgagccggatgggcgcgaagcacctctccgtggaggacgtgtacgatttggagttcttcgacgactacatctataacagggatgtggtcagcgtggagcacgtcctcagcatcgagctgtacaaaacggagaaggagaaggagaaggagcgggaggagcgggaggagcagaaggagcgggaggagcgggaggagcagaaggagcagaatgccgctgatggaagcaccgggggaggggcgcccccgaaaagggagatgtaccgaaacacagccgaaacggacgaaaagtactaccggctcataagaaacgaaaacagcatttttggaattattttcctttttaacatcgggaagagctacaagaggaacaagttcgtggagcacagtgtgccagagaacctcttctttgcaaagcaggtgatcccgaacgcatgtgccacgcaagcaatcctgtctattgtcctaaatataggggtagaactgaacgaagaaataaaaaacatcaaatcgtttagcaataactttgatagctcgatgaaggggctcaccctctccaactgtaacttccttcgaaacatccacaatacgtataagcctcccatatatatagaaaaggagaacctgcatgacgaaaagggaaagaacaacgactccttccacttcgtttcgtatatacaatttggcgggagtgtctacatgctggacggcctgcaggaggggcccgtgctcatcgggcagaccgggggcgcggacggccgccgcagttgggtcgacctcgccagggagcacatcaagaaggagatcgacgagatatgcggggttagcggtggtagcggagttagcggcggtgtgggtggaagcagcggtggccgtggcggcagcggtgggggggacgggcggttcaacatcctaatcgtggtgaaggacaaggagtatttgctcaaagagttttataaaatccacagaattttgtataagagactcttcaccaagttacgcagcctgggggtgaaggaggaattattactggacccagtacacgataaaataaacgaccaactgagcgaagagataagcgcagaaatgaacggccaagtaagcggccaagcaaacggccaagcgaacggccaagcaaacgtccaagcgaacggccaagtaatcgaagaaaagtttaactacgcgaatatccccaccgtggaggagctcccagacaatatcggagagctgctgaccactttccataagtcccaatttgaaatcaactacctgcaggcccttttgcaggagcagaagcagttgaagcgctcctcgaagaaggagctggccttcaaatattttaatttctaccccttcgtgatgtcctctttgaagctcatggccaagcacaagttcttgaaggaggcctaccagaagcagaagcagaagcgcaggcgggccatcgcc

SEQ ID NO: 80 - protein, 21 aa, Plasmodium yoelii
SGWKFEEQEGDVNMVLTKNVD

SEQ ID NO: 81 - protein, 33 aa, Plasmodium yoelii
IIDFQLVSPFQAEGENEAQAEMTDFSVTVEKPN

SEQ ID NO: 82 - protein, 36 aa, Plasmodium yoelii
GGITFYCTTLQNDEKFRYMIGNVKYYKNEEGKNSVS

SEQ ID NO: 83 - protein, 47 aa, Plasmodium yoelii
YNGPEFEDLDDSLQTSLDEWLANLGVDSELCDFIDSCSIDKEQREYM

SEQ ID NO: 84 - protein, 252 aa, Plasmodium yoelii
MNFLRRNTVSLCKSHALNKTLNNSGNVFAKLSKRKFTDINSIAKCSQSAQTKFNFGDGRKYASSEAQKLSEVVKSEVQHEKSNYEAPENIKKFLQNSGWKFEEQEGDVNMVLTKNVDDMKVIIDFQLVSPFQAEGENEAQAEMTDFSVTVEKPNKQGGITFYCTTLQNDEKFRYMIGNVKYYKNEEGKNSVSSYNGPEFEDLDDSLQTSLDEWLANLGVDSELCDFIDSCSIDKEQREYMAWLQNISNFIES

SEQ ID NO: 85 - protein, 252 aa, Plasmodium falciparum
MNSLLRNTLNSSKGKIFTKYLNNSFNKVANLNSRKVSNFTKYGKCVQRVDKNFNTINKRSFSSSEAQKLSEVVKAEVQHEKSNYEAPDNIKKFLQTSGWKFEEQEGDVNMVLTKNVDGMKIIIDFQLVSPFQAEGENEAQAEMTDFSVTVEKPNQNGGITFYCTTLQNDEKFRYMIGNVKYYKNEEGKNSVSAYNGPEFEDLDDSLQTSLDEWLANLGVDSELCDFIDSCSIDKEQREYMSWLQNISNFIEA

SEQ ID NO: 86 - protein, 254 aa, Plasmodium vivax
MNFLRRNAANLCKGKVLGKHLNCSVHELTNLNKRKISNITDLGKCGQRYQATHSGSTIGAKRFASSEAQKLSEVVKAEVQHEKSNYEAPDNIKKFLQTSGWKFEEQEGDVNMVLTKNVDGMKIIIDFQLVSPFQAEGENEAQAEMTDFSVTVEKPNKQGGITFYCTTLQNDEKFRYMIGNVKYYKNEEGKNSVSAYNGPEFEDLDDSLQTSLDEWLANLGVDSELCDFIDSCSIDKEQREYMSWLQNISNFIES

SEQ ID NO: 87 - DNA, 756 bp, Plasmodium yoelii
atgaattttctacgtagaaacactgtgagcttatgtaaaagccatgctttaaataaaaccctgaacaattcaggaaatgtgtttgcaaaactaagtaaaagaaaatttacagatattaatagtattgcaaaatgtagccaaagtgctcaaaccaaatttaactttggtgatggaagaaaatatgcttcaagtgaagctcagaaattgtcagaagttgtgaaatcagaagttcaacatgaaaaatcaaattatgaagcacccgaaaatattaagaagtttttacaaaattccggatggaaatttgaagagcaagaaggagatgtaaatatggtattgacaaaaaatgtagacgatatgaaagtcattattgattttcagcttgtatctccatttcaagcggaaggagaaaatgaagctcaagctgaaatgactgatttttcagtaacagttgaaaagccaaataagcaaggaggtataactttttattgtactactcttcaaaatgacgaaaaatttagatatatgataggaaatgtcaaatattataaaaatgaagagggaaaaaactctgtatcatcttacaatggcccagaatttgaagatttggatgactctttacaaacatcacttgatgaatggttagcaaatttaggagtcgactcagaattgtgtgactttattgattcatgcagcattgataaagaacaaagagaatatatggcctggttacaaaacatttcaaattttattgaatcc

SEQ ID NO: 88 - DNA, 756 bp, Plasmodium falciparum
atgaattctcttttaagaaacactttaaattcttccaagggtaaaatttttaccaagtatttgaacaattcctttaataaggtagctaatttaaatagtagaaaggtttctaactttacaaagtatggaaaatgtgtacagagagttgacaaaaatttcaacacaattaacaagaggagcttttcttcgagtgaagcacaaaaattatcggaagttgtaaaagctgaagtacaacatgaaaagtccaattacgaagctccagataatataaagaagtttttacaaacttcaggatggaaatttgaagaacaagaaggagatgtaaatatggtattaaccaaaaatgttgatggaatgaaaattattattgactttcaacttgtttctccatttcaagcagaaggagaaaatgaagctcaagccgaaatgacagatttttctgtaactgttgaaaaaccaaatcaaaacggaggtataacattttattgtacaactttacaaaatgatgaaaaatttagatatatgataggaaatgtaaaatactataagaatgaagaaggaaaaaattctgtatcagcttataatggacccgaatttgaagacttagatgattctctacaaacatctcttgatgaatggttagctaatttaggagtagattcagaattatgtgatttcattgattcctgcagtatagacaaggaacaaagagaatatatgtcatggttacaaaatatttcaaattttattgaagct

SEQ ID NO: 89 - DNA, 762 bp, Plasmodium vivax
atgaatttcctgaggagaaacgctgcaaatttgtgtaaaggcaaagtcttggggaagcacctgaactgctctgtgcacgagctaaccaacctgaataagagaaagatttccaacataaccgaccttgggaaatgtgggcaaaggtaccaagcaacccattccggctctactattggagcaaaaagatttgcttcaagtgaagcgcagaaactgtccgaagttgtgaaagcagaggtgcaacatgagaagtcgaattatgaggcaccagataatattaagaagtttttgcaaacgtcggggtggaaatttgaggaacaagaaggagatgtcaacatggtgttaaccaaaaatgtggatggaatgaaaattattatcgattttcaacttgtgtctccatttcaagcagaaggagaaaatgaagcgcaagcagaaatgactgacttttctgttaccgttgaaaagccaaacaaacaaggaggcattaccttttattgcaccaccttacagaatgatgagaaattcagatatatgattggaaatgttaagtattataaaaatgaagaaggaaaaaattccgtgtcagcttataatggacccgaatttgaagacctggatgactccctacaaacttcgctcgatgaatggttggcgaacttgggagtagactccgagttgtgtgattttatcgattcctgtagcattgacaaagagcaaagagaatacatgtcatggttacagaacatttcgaattttatcgaatct

SEQ ID NO: 90 - protein, 174 aa, Plasmodium yoelii
MKNLSILTYTSIRSLTNLYISQMLSNKNWNEIKKTNQEIFNLNNVQDSKNCSNWNSISIDNETESFNKKEKNNETETVTDSFIKKEKQIANINTQIKDNLYNLENKQIYTIGDVSVITELCSSIIDLLTVIFLSKATHFIKHNLYFYIVLSSCHLFFSYKELQYLLASNNELNK

SEQ ID NO: 91 - protein, 381 aa, Plasmodium falciparum
MKFFVFHLLFILLSYNSFTYVLNKNIKTLSLSSNIYKKNLFCRKKNIRPLKIYVYPSFIKNIIKPLENAYFRNYFMYRSLARICVSLSSAFSLGAKLYLYKKNMNSLFLTQLLMNNEILIKILKICWLYKLSHFIDKNVKLCRYLSTVFYIISIYLDIFSTYNLANNIYIYYLFYSLSSILKSLSILTYTSIRSNINFQVYQMLTLQKKNYEKKYKISNTSHKNNTPIDRYSHSTSSTNVEHNNIHSNDNATTIHKNNILNESTQNGHNNIENIHLKNNVIHNTKDVHNNLDIHSEVENTDEDYKIYDNHIEKNKLSINTKNFCIGEISVIIDLLSTLVDLSTILFLFQATKFIKQNLCFYIFISALHLFFSYKEIQYLLI

SEQ ID NO: 92 - protein, 381 aa, Plasmodium falciparum
MKFFVFHLLFILLSYNSFTYVLNKNIKTLSLSSNIYKKNLFCRKKNIRPLKIYVYPSFIKNIIKPLENAYFRNYFMYRSLARICVSLSSAFSLGAKLYLYKKNMNSLFLTQLLMNNEILIKILKICWLYKLSHFIDKNVKLCRYLSTVFYIISIYLDIFSTYNLANNIYIYYLFYSLSSILKSLSILTYTSIRSNINFQVYQMLTLQKKNYEKKYKITNTSHKNNTPIDRYSHSTSSTNVEHNNIHSNDNATTIHKNNILNESTQNGHNNIENIHLKNNVIHNTKDVHNNLDIHSEVENTDEDYKIYDNHIEKNKLSINTKNFCIGEISVIIDLLSTLVDLSTILFLFQATKFIKQNLCFYIFISALHLFFSYKEIQYLLI

SEQ ID NO: 93 - protein, 396 aa, Plasmodium vivax
MAPFPHAEKCTHLLVALSSCFSFRSPRGASPNVGHLMCSPARKKGIIQRGPLTIRASHNFLSSITTPLLNENFKKYFAFRCLSRICVSLSSAFSLNAKIHLYRKNSNNLLLTQVLLYNEILVKVLKICWLYKLRSFVDSNIKMCRILSTVFYVTGIYLDLLSTLEIFKNSFFFPCALYVLSSTLKSLSIMTYASIRSATNLRLCEMLNGPGAGAPGVLHNHSNGNNNSSNSNNRTDRGEPTHDHLPTEEQTREDTDGAKPKGDDVAIRLGEDAHAPVLGAEQGGDTPLESLSNGTIPHSEHGNHCSSRSSRSSHSSHSSHSSHSSRASTPANGVKKTYYIGEVSVLTDLLASLVDLLTVVLLARTTKYIERKIFFYVILSALHLFFSYKELQCLLK

SEQ ID NO: 94 - DNA, 522 bp, Plasmodium yoelii
atgaaaaatttgagtatactaacatatacctcaataagatctttaacgaatttatatataagtcaaatgctctcaaataaaaactggaatgaaataaaaaaaactaatcaagaaatttttaatttaaataatgtccaagatagtaaaaattgttcaaattggaatagtataagcatcgataatgagactgaaagttttaataaaaaagaaaaaaataatgaaactgaaactgttactgattcatttataaaaaaagaaaaacagattgcaaatattaacacccaaattaaagacaatttatataatttagaaaataaacaaatatatactattggggatgttagtgttataacagaattatgttcttcgattattgatttgttaactgtaattttcttatcaaaagccacacattttataaagcataatttatatttctacattgttttatcatcttgtcatttatttttttcgtacaaagagttgcaatatttattagcttcaaacaatgaactaaataaa

SEQ ID NO: 95 - DNA, 1143 bp, Plasmodium falciparum
atgaaattttttgtatttcaccttttatttattttgttgtcatacaatagttttacttatgtgctgaataaaaatattaaaactctgagcttatcttcgaatatttataagaaaaatctcttttgtagaaaaaaaaatataagaccattaaaaatttatgtttatccaagttttataaaaaatataattaaacctttagaaaatgcatattttagaaattattttatgtatcgatccttagctcgaatatgtgtatcattaagtagtgcattttccttaggtgcaaaattatacttatataaaaaaaatatgaatagtctatttttaacacaattattgatgaataatgagatacttataaaaatattaaaaatatgttggttatacaaattaagtcattttatagataaaaatgtaaaattatgtagatatctctccaccgttttttatattattagtatatatctagatattttttcaacgtacaatctagcaaataatatatatatttattatttattttattctttatcctccatattaaaaagcttaagtatattaacatacacttctattagatcaaatattaattttcaagtctatcaaatgttaacattacaaaaaaaaaattatgaaaagaaatataaaataagcaatacttctcataaaaataatacgcctatcgatagatatagtcatagtacttctagtactaatgtagaacataataatattcattctaatgataatgcaaccaccatacataaaaataatatattaaatgaatctacgcaaaatgggcacaataatatagaaaatatccatttaaaaaataatgtaattcataacacgaaagatgtacacaacaatttagatattcatagtgaagttgaaaatacagatgaagattataaaatatatgataatcatattgaaaaaaataaattatctattaatacaaaaaatttttgtataggagaaataagtgttataattgatttattatccaccttggtagacttatctactatacttttcttgttccaagcaacaaaatttataaaacaaaatttgtgcttttatatctttatatcagcattgcatttattcttttcatataaagagatacaatatttgttaata

SEQ ID NO: 96 - DNA, 1143 bp, Plasmodium falciparum
atgaaattttttgtatttcaccttttatttattttgttgtcatacaatagttttacttatgtgctgaataaaaatattaaaactctgagcttatcttcgaatatttataagaaaaatctcttttgtagaaaaaaaaatataagaccattaaaaatttatgtttatccaagttttataaaaaatataattaaacctttagaaaatgcatattttagaaattattttatgtatcgatccttagctcgaatatgtgtatcattaagtagtgcattttccttaggtgcaaaattatacttatataaaaaaaatatgaatagtctatttttaacacaattattgatgaataatgagatacttataaaaatattaaaaatatgttggttatacaaattaagtcattttatagataaaaatgtaaaattatgtagatatctctccaccgttttttatattattagtatatatctagatattttttcaacgtacaatctagcaaataatatatatatttattatttattttattctttatcctccatattaaaaagcttaagtatattaacatacacttctattagatcaaatattaattttcaagtctatcaaatgttaacattacaaaaaaaaaattatgaaaagaaatataaaataaccaatacttctcataaaaataatacgcctatcgatagatatagtcatagtacttctagtactaatgtagaacataataatattcattctaatgataatgcaaccaccatacataaaaataatatattaaatgaatctacgcaaaatgggcacaataatatagaaaatatccatttaaaaaataatgtaattcataacacgaaagatgtacacaacaatttagatattcatagtgaagttgaaaatacagatgaagattataaaatatatgataatcatattgaaaaaaataaattatctattaatacaaaaaatttttgtataggagaaataagtgttataattgatttattatccaccttggtagacttatctactatacttttcttgttccaagcaacaaaatttataaaacaaaatttgtgcttttatatctttatatcagcattgcatttattcttttcatataaagagatacaatatttgttaata

SEQ ID NO: 97 - DNA, 1236 bp, Plasmodium vivax
atggcgccttttcctcacgcggagaagtgtacccatctccttgttgcactctcttcttgtttttccttccgctctcctcggggtgcttctccaaatgtgggtcacctcatgtgtagccccgctagaaaaaagggaataattcaaaggggtcccctgaccattcgcgcgtcccacaattttttaagcagcataactacacccctgttgaatgaaaactttaaaaagtacttcgccttccgatgcctgtcccgcatatgcgtatcgttaagtagcgccttctccttaaatgcaaaaatacatttgtataggaaaaatagtaacaacctgttgctgacccaagtcctcctctacaatgagattctcgtgaaggtgttgaagatctgttggctctacaagctcagatcctttgtggatagtaatataaaaatgtgtagaattctgtctaccgtcttttacgtcactggcatttacttggatttactttctactttggaaatttttaaaaattctttttttttcccctgcgccttgtacgtcctttcgtccacccttaagagtttaagcatcatgacgtatgcgtccatccggtccgccacgaaccttcgcctgtgcgaaatgttaaacgggccaggtgcgggtgcccccggggtgcttcacaatcatagcaatggtaataataatagtagtaatagtaataatcgaacggacaggggggaacccacacatgatcacctacccactgaggaacagacgcgggaagatacggatggggcaaagccgaagggggacgacgtggcaattcgcctgggggaagatgcgcacgcgcctgttcttggtgcagagcagggaggcgacacccctctggagagtttatcaaatgggacgatcccccacagtgaacatggcaaccattgcagcagtcgcagcagtcgcagcagtcatagcagtcatagcagtcatagcagtcatagcagtcgcgctagtacccccgccaacggtgtaaagaaaacgtactacattggcgaagtgagtgtcctcacggatttgctggcctccctcgtggacctcctcaccgttgtgcttctcgcacggacgaccaagtacatagagaggaaaattttcttttacgtcatcctgtccgctctgcatttgtttttctcctacaaggagttgcagtgcttgttgaaggctctgcatttgtttttctcctacaaggagttgcagtgcttgttgaag

SEQ ID NO: 98 - protein, 173 aa, Plasmodium yoelii
MNRQGKYDIFPPPLEKINNNNKTQVPKKCPEKTEKTEKTEKTEKTEYPFLVNDERSNIKHQSENKCFNKNDMVNEKINKVDPNILNKYNNLILNTNEINLIINDNANFKELLSNNQVSNFMNEYLTAPLEAIAKYKNDKTVINFLEILFKYMNAKQKHIHLNNISETFTFGTK

SEQ ID NO: 99 - protein, 158 aa, Plasmodium falciparum
MNKKNTTYDILPPPLEKIHKNVEKKDIIHNNNNIIIKEDNKCKIKNEDIKTNVNNTFDKNNIILNNNVADKYKNIILNINEINTILKDHPHFKQMVENENVTEFMDKYLINPIEAIMKYKSDQHVIEFLNTLFKYMNAKRNYIHINNLPQSFTFHKKK

SEQ ID NO: 100 - protein, 208 aa, Plasmodium vivax
MDGKKGPIYDILPPSLEKIKKTDRRRSQGEAKELPRNELALGPPQRGAQPLKMGPTPREGAKQMKQHTEETKQHTEQTKQHTEQTKQHTEQTKQHTEQTKQHTKHTGHTEQTERAANHVAQKYSNVILSSDEISAIISSNAHFKTLVESEKVSSFMGDYLENPLVAIKKHGKDETIAQFLDCLFRYMTQKSRSIHLANLPDNFTIPRR

SEQ ID NO: 101 - DNA, 519 bp, Plasmodium yoelii
atgaacaggcaaggtaaatatgacatttttcccccaccccttgaaaaaataaataataataataaaacccaagttcccaaaaagtgcccagaaaaaacagaaaaaacagaaaaaacagaaaaaacggaaaaaacggaatatcctttcttagtgaatgatgaacgaagtaatataaaacaccaaagtgaaaataaatgttttaacaaaaatgatatggttaatgaaaaaataaataaagttgaccctaacatactaaataaatataataacctaattttaaatactaacgaaataaatttaataataaatgacaatgcaaattttaaagaattattatctaacaatcaagtctcaaactttatgaacgaatatttaactgcccctcttgaagcaattgccaaatataaaaatgataaaactgttattaattttttggaaatattgtttaaatatatgaatgcaaaacaaaagcatatacatttaaataatatttccgaaacattcacttttggcacaaaa

SEQ ID NO: 102 - DNA, 519 bp, Plasmodium falciparum; identical to SEQ ID NO: 101

SEQ ID NO: 103 - DNA, 624 bp, Plasmodium vivax
atggacgggaagaagggccccatctacgacatcctccccccctcactggagaaaataaaaaaaacggacaggagaagaagccaaggtgaagcgaaggaactgccccgtaatgagttggcactgggacccccccaacggggtgcacagcccctcaaaatgggtcccacgccacgggaaggggccaaacaaatgaagcagcacacggaggaaacgaagcaacacacggagcaaacgaagcaacacacggagcaaacgaagcagcacacggagcaaacgaagcaacacacggagcaaacgaagcaacacacgaagcacacgggacacacggagcaaaccgagagggccgctaaccacgtggcccaaaagtacagcaacgtcatcttaagcagcgacgaaatcagcgccatcatcagcagcaacgcacacttcaaaacgctcgtcgaaagtgaaaaggtatcctcctttatgggggattatttggagaacccactcgtggccataaaaaaacacgggaaggacgaaacgattgctcaattcctcgactgcctcttccggtacatgacgcagaagagtcgcagcattcacttggccaacctgcccgacaactttaccatcccgcggagg

SEQ ID NO: 104 - protein, 20 aa, Plasmodium yoelii
  MISC_FEATURE (20)..(20): X is an asparagine (N) residue or a serine (S) residue
LLKHGWCEMLKGGVIMDVKX

SEQ ID NO: 105 - protein, 26 aa, Plasmodium yoelii
  MISC_FEATURE (9)..(9): X is a lysine (K) residue or a glutamic acid (E) residue
VEQAKIAEXAGAIGVMVLENIPSELR

SEQ ID NO: 106 - protein, 23 aa, Plasmodium yoelii
SINVLAKVRIGHFVEAQILEELK

SEQ ID NO: 107 - protein, 41 aa, Plasmodium yoelii
KHKFKTPFVCGCTNLGEALRRISEGASMIRTKGEAGTGNII

SEQ ID NO: 108 - protein, 29 aa, Plasmodium yoelii
ATPADAAMCMQLGMDGVFVGSGIFESENP

SEQ ID NO: 109 - protein, 40 aa, Plasmodium yoelii
  MISC_FEATURE (11)..(11): X is an isoleucine (I) residue or a valine (V) residue
LPVVNFAAGGXATPADAAMCMQLGMDGVFVGSGIFESENP

SEQ ID NO: 110 - protein, 20 aa, Plasmodium yoelii
LLKHGWCEMLKGGVIMDVKN

SEQ ID NO: 111 - protein, 20 aa, Plasmodium falciparum
LLKHGWCEMLKGGVIMDVKS

SEQ ID NO: 112 - protein, 26 aa, Plasmodium yoelii
VEQAKIAEKAGAIGVMVLENIPSELR

SEQ ID NO: 113 - protein, 26 aa, Plasmodium falciparum
VEQAKIAEEAGAIGVMVLENIPSELR

SEQ ID NO: 114 - protein, 40 aa, Plasmodium yoelii
LPVVNFAAGGIATPADAAMCMQLGMDGVFVGSGIFESENP

SEQ ID NO: 115 - protein, 40 aa, Plasmodium falciparum
LPVVNFAAGGVATPADAAMCMQLGMDGVFVGSGIFESENP

SEQ ID NO: 116 - protein, 297 aa, Plasmodium yoelii
MRDYTDNDSILLKHGWCEMLKGGVIMDVKNVEQAKIAEKAGAIGVMVLENIPSELRNTDGVARSVDPLKIEEIRKCISINVLAKVRIGHFVEAQILEELKVDMLDESEVLTMADEYNHINKHKFKTPFVCGCTNLGEALRRISEGASMIRTKGEAGTGNIIEAIKHIRTVNNEIKYLCSLDESEVYNFAKKLRAPIDLILLTRKLKRLPVVNFAAGGIATPADAAMCMQLGMDGVFVGSGIFESENPQKMASSIVMAVSNFNNPKILLNVSLGLGKAMHGNTKVSNKWKNKSEEDNS

SEQ ID NO: 117 - protein, 301 aa, Plasmodium falciparum
MENHKDDAVLLKHGWCEMLKGGVIMDVKSVEQAKIAEEAGAIGVMVLENIPSELRNKEGVARSVDPSKVEEIKKCVSINVLAKVRIGHFVEAQILEELKIDMIDESEVLTIADEMHHIDKHKFKTPFVCGCTNLGEALRRISEGASMIRTKGEAGTGNIIEAIKHIRTVNNEIKYLCSLSDSEVYHFAKKINAPIDLVLLTKKLKRLPVVNFAAGGVATPADAAMCMQLGMDGVFVGSGIFESENPRKMAASIVSAVSNFNNPKILLDVSMNLGKAMCGSTRVSDKWKNKNEEHTKFLTPQ

SEQ ID NO: 118 - protein, 302 aa, Plasmodium vivax
MENAKRMDDHKDNDSILLKHGWCEMLKGGVIMDVKNVEQAKIAEEAGAIGVMVLENIPSELRSKESVARSVDPSKVEEIKKSVSINVLAKVRIGHFVEAQILEELKVDMIDESEVLTMADENNHIDKHKFKTPFVCGCTNLGEALRRISEGASMIRTKGEAGTGNIIQAIKHVRTVRNEINYLCALSESEVYNYAKRISAPLDLLLLTRKLKKLPVVNFAAGGVATPADAAMCMQLGMDGVFVGSGIFESENPRRMATSIVAAVSNFNNPKILLNVSLNLGKAMCGSTTICEKWKNKNEELN

SEQ ID NO: 119 - DNA, 891 bp, Plasmodium yoelii
atgagagattacacagataatgattccattctacttaaacatggatggtgtgaaatgttaaaagggggagttataatggatgtaaaaaatgtagagcaagcaaaaatagctgaaaaagctggtgcaataggtgtaatggttttagaaaatattccatctgaacttcgaaatactgatggagtagctagaagtgtagacccattgaaaattgaagagataagaaaatgtatttctataaatgtgttagctaaagttagaataggtcattttgttgaagcacaaattttagaagagctcaaagttgatatgcttgacgaaagtgaagtattaactatggcagatgaatataaccatataaataaacataaatttaaaaccccatttgtatgtggatgtacaaatttaggagaagcattaagaagaatatcagaaggtgcttctatgataagaaccaaaggtgaagctggaactggaaatataattgaagctattaaacatataagaacagtaaataatgaaataaaatatttatgttcattagatgaaagtgaagtatataattttgctaaaaaacttagagcaccaattgatcttatattacttacgagaaaattaaaaagattaccagttgttaattttgctgctggaggaatagctacacctgcagatgctgctatgtgtatgcaattaggaatggatggtgtttttgtaggatcaggaatatttgaaagtgaaaatcctcaaaaaatggcttcatctatagttatggctgtttctaattttaacaaccccaaaatacttttaaatgttagtttagggttaggaaaagccatgcatggaaatacaaaggtatcaaataagtggaaaaataaaagtgaagaagataattca

SEQ ID NO: 120 - DNA, 903 bp, Plasmodium falciparum
atggaaaatcataaagatgatgcagttttattaaaacacggatggtgcgaaatgcttaaaggaggagttattatggatgtaaaaagtgtagaacaagcaaagatagctgaagaagctggagctattggtgtaatggttttagaaaacattccttctgagcttaggaataaggaaggtgttgcaagaagtgtagatccatcaaaagtagaagagataaagaaatgcgtttctattaatgttcttgctaaagttcgtattggtcattttgttgaagcacaaattttagaagagcttaaaattgatatgatagatgaaagcgaagtattaacaattgctgatgaaatgcatcatattgataagcataaatttaaaactccttttgtatgtgggtgtacaaatttaggagaagctctaagaagaatatctgaaggagcttctatgataagaactaaaggagaagctggtacaggtaatattatagaagctattaaacatataagaactgtaaataatgaaatcaaatatttatgttctttaagcgatagtgaagtctatcattttgctaaaaaaattaatgcacctatcgatcttgttttacttacaaaaaaattaaaaagattaccagttgttaattttgctgctggaggtgttgctactccagctgatgcagccatgtgtatgcaattaggaatggatggagtttttgtagggtcaggtattttcgaaagtgaaaacccaagaaaaatggcagcttcaatcgtttcagctgttagcaattttaataaccctaaaatacttttagatgttagtatgaatttaggaaaagccatgtgtggaagcacacgcgtttcggataaatggaaaaataaaaatgaagaacacaccaaatttttaacaccacaa

SEQ ID NO: 121 - DNA, 906 bp, Plasmodium vivax
atggaaaacgcgaaaagaatggacgaccacaaagataacgactccatcctgctgaagcacgggtggtgtgaaatgctgaaggggggagtcatcatggacgtgaagaatgtagagcaggccaaaatagcggaggaagctggcgccatcggtgtaatggtccttgagaatatcccctcggagcttcgaagcaaagaaagtgtggcgagaagtgtcgaccccagtaaagtggaagaaataaaaaaaagcgtctccattaatgtactagccaaagtacgcataggccattttgtagaggcacaaattctagaagaacttaaagttgatatgattgatgagagtgaagttctaacaatggctgatgagaacaaccatattgataagcataaatttaagacgccttttgtatgcggatgtaccaatttaggggaagctttgaggagaatttcagaaggagcttccatgataaggaccaagggagaagcaggaacgggaaatataatacaagctataaaacacgtaaggacagtaaggaacgaaattaactacctctgtgcgttgagcgaaagtgaagtttataattatgccaaaaggattagtgctcctttggatctcctcctactcacaagaaagttaaagaaattgcccgttgttaattttgctgctggaggagttgccaccccggcagatgccgccatgtgcatgcaactcggaatggatggcgtctttgtaggctccggaattttcgaaagtgagaaccccaggaggatggccacctccattgttgccgctgtgagcaactttaacaaccccaagatactcctgaacgtcagcctcaacttgggcaaggccatgtgcggcagcaccaccatatgcgagaagtggaagaacaagaatgaggagctgaat

SEQ ID NO: 122 - protein, 441 aa, Plasmodium yoelii
MNGELECDYSTYDLLFCPTTPWPCLSFDFIYDNQNKEDVISQSKINGKKFKENKLTYPIDITCVSGTQATDKESNNIYVIKWGNLNKLDLYLSSEDLSSDDEHIKNKKNIEKNNSDNNKASEDDSVIICKSIKHTHGCINRIKSSKKINSLVGAWCEDKKVYIYEIRDEIEGLNERIYNENIQKDPVYIFNKHSNEGFAIDWNPVYGAQLLTGDNDGNLFLWLPDNMAKWKHENLNSTSIKNNCNKYSIEDIQWIKKGNGLGHVFAICSSDKSIKIVDTRDIKSVSDENQMQNLVNREIGFKIDIPNAHSSDVNVITWNENFEFLLASGGDDSVVKIWDIRNTSKNVASLNFHKDSITSISWDSKDTYVLLTSSLDNSISVWDLSVESEGLEDSFAQYPDQLLFEHKNQNFITDAKFHPSYPGVIVSTSGECFNIFKPYNT

SEQ ID NO: 123 - protein, 484 aa, Plasmodium yoelii
MKIVKELSKKGKIKWRRFISSQSLQNYNSLKNVDEDNYNILSTYKNKSYLNLSICNNVIPKYVHDCLVNNLNKNATLNLEHLKIIEDRALAAFNLENKYWGCVFNTSSHTEYTNSMDEYFLLKLFKNFVNYQSKIMIITFTLLGKELQEKNNKEESRMDKNILDEFYNILYIKNNDKINYMEIKNQCEQFNPDLIYIDETNNPYNFNYEFITTLRNIKRKINNNVYNGKSGVEDKNNTLVITNISNKASFIIGNFISSPFSQADIVFSYLNENIRANNCYIIFYRKGFKNISTQGKLICYEYEDNLKKTYFQNNVNNIICSLSTSFKCIQNCEFKEYIYQINKNINILFLYLNKKYFNIHFDQNNNFLNTACSNSLFNIQEYHIFCKKLNIFFDIININKSTYVQKSFNIGTNYLTALGMEEHDMKYVSEFINQSILLYLYTKQKSANSNLTFLEYLESSFISSDILALSNDIHSFVSMFPSPS

SEQ ID NO: 124 - protein, 331 aa, Plasmodium yoelii
MGRKKRKINIELKPFCYYCDREFDDEKVLIQHQKAKHFKCSQCNRKLDVATGLVVHMMQVHKTNLKTVPNSLPKRNDPEIVIRGMNGVPTEIIEENLNKLKQKLGDKNIKRQQRVNWAQVTMAPTMEQFLQQAQMGNFYFPGFNSPHIQPTNNMILNNNIDLKKNMPYIPLYPPGSNSNAPIIQPPPIGANIYQNMLTQIPSQHSIGYPGNLSSQNINTSQKYPPNINFPTLPFLPKLPHNTFPSMDSNFMPQNICPPPVPPSAPPSGPPLLPPSAPLIPSAPPNLAQNKANNSTENIPDQTNEDKAEDMNPSKESPNSTSNNDNSKKDDK

SEQ ID NO: 125 - protein, 161 aa, Plasmodium yoelii
MSDHETYDNIDAGASQTYPVQAGAIKKNGHVMLKEHPCKVVDYSTSKTGKHGHAKAHIVGIDIFTGKKYEDICPTSHNMDVPVVKRTELQLIDITEDGFVSLLFDNGDTKDDLSLPKDSEGNFDDVAKQIRNLFDSGKSVLVSVLSACGQEKIIAAKEMSS

SEQ ID NO: 126 - protein, 559 aa, Plasmodium yoelii
MINKEEAQRLKELGNKCFQEGKFEDSVKYFSDAIKNDPSDHVLYSNLSGAYSSLGRFYEALESANKCINIKNDWPKGYIRKACAEHGLRQLDNSEKTYLEGLKLDPNNKSLKDGLEKVRKDKEMENMEYINHINNIINNDAKLKSYKEENSNYPIELLNTIKAINANPMNIRFILSSCNPKISEGVEKFFGIKFNDEASYEAERERQRKKEEEEKKEKERKMKEEEKKKNRTPEEILGEEHKLKGNDFYKQKKFEEALKEYDEAIKVNPNDIMYYYNKAAVYLEMKSYEKCIETCIYAIENRYNFKAEFSQVAKVYNRLAIGYINIKNYDKAIEAYRKSLVEDNNRATRNALKELERKKEKEEREAYIDPVKAEEHKNKGNEFFKNNDFPNAKKEYDEAIRRNPNDAKLYSNRAAALTKLIEYPSALEDVMKAIELDPKFVKAYSRKGNLHFFMKDYYKAIQAYNKGLELDPNNKECIEGYQRCVYKIDEMSKSEKVDEEQIKKSMADPEIQQIISDPQFQIILQKINENPNSISEYIKDPKIFNGLQKLIAAGILTVR

SEQ ID NO: 127 - protein, 941 aa, Plasmodium yoelii
MSSMFNENELSGIDAHSVFGNNNNNERENYENKRKRFNENSNISVNQRTEDEEDEEDDEEDEEPSHVQDENMAKVFEKFLKTFSEKKNGKTDGDSDDDNDSVWRDNLNFDFPTELEIGNNAHYVQILYTILQNSFSRNKVLVVDMKHVLMWEPTDRNRFDIGSQLYMYIKRHFLRILDIFEQKVQILAESINPIKTKEVGKICLRFYNKKNPIHSLRSLRCEMLGEMISVRGQVTRTSDVRPELTLASFKCNECGNIINGVKQQFRYTQPNKCPSASCSNMHDWSLVLEQSYFVDWQKIRLQEIAQESPPGSMPRNMDVILRNDIVDSVHAGDRIIVTGCLIVVPDIPTLMKPGDIPRSVARQMLKKNENSLVSQGLTGIKGVGVQDLNHKLCIYACQIEKLNSSKKDSSFDEETQVDINCEEILNCDDLKWLREIAMHPNTIDILAECIAPKIWGNIEIKKGALLMMTGGVQKITSNCKLRGDINMCIVGDPGTAKSEILKYVESFAPRAIFTSGKGSTAAGLTAAVHRDPDQGDTVLEAGALMYADQGICCIDEFDKMDEKDRVAIHEAMEQQTISITKAGIQATLNARASVLAACNPKYGRYDSLKTFAQNVNIPAPLLSRFDLFYTMLDSIDIDKDTNIANHLVSMHCGEEAEKHLKANAGKLDNVKLEIYLELSKRVKPLLTDEAKYKLIHYYVSFRNIEYSPGAQRSMRMTVRQLESLIRLSEAVAKLKFSHFVDVKHVEIACSIFKASMKKISNEKEINLDEEPEKIGNVSTSMGNENNGINNGDNQTDKNIEVKKTTVIKASEYQCISAIIFEIIKEYEFNNNNECMTQDQLIESYLKDYAKAESTEHLDEWIHKLKKIISRLINQDMKLLSETNENDPENIILRIHPNYAGPSTEGIVSNKNMYGYNTFKNYQADQNVPDDDVDFQDDIENF

SEQ ID NO: 128 - protein, 532 aa, Plasmodium yoelii
MNLDLKTNKNKQIVVSFISGCNYNNLYNRENKKSLKIAKDDTKINSLKNDKYSEHVNIDEKYDKNDYINKLYENEFYDSTNYNVYIENNKLAEYISDVSINKNEICTLYEDMNLGRLFENLVAKLYYNKKINGFVHLYNGQEAISTGIIKNLRNSDFVVSTYRDHVHAISKNVPVKEILNELYGNYYGSTNQGKGGSMHIYNKKNNFIGGFGFIGEQIPISVGLAYSVLYKKEFIQDTSNKEYETCSEKQNTLMNHVNDVKENLTKHDENEHDKNENDLDVVVCFLGDGTSNIGQFFESLNLASTYNLPIIFVIENNNWAIGMESSRSSLGDLTNNYNKGKAFNITTYKVDGNDVLSIYKLAKKKINEIRKKKSGPILIEAITYRTRGHSLADPDLLRRLDEKTSWKKIDPIIQLTNYMKNNNIVDSIYFENTKKEIQKILLDAQNDADSNFEKSKNIDVCKLYDNNIFAPSEITKYQPSYSKYKKYDQLSPNELIQYYQSYMNEINGKFIKNDKNYYSQIFDKKQLPLIIN

SEQ ID NO: 129 - protein, 439 aa, Plasmodium yoelii
MNAMKNIECIILYAQNKFILQNIDQNNYNVEFDKIMENINNIKNVINNRNNTMNDDIVNCINDTKKIYKSNDKYNLFILDDYMLYNISKENTSIQPNIENNLEQFIINGFNFMGKGIIIKDYNNNANIIDLAKYNNYNSIFNNMNVNKFKNKYIALKILRKIIKKYKDNGYVAKFDIKIILTHIEYPLTLYFIYLYNKFREYTNYINIKLNDQKNGCITNVENEINICFYTLNDIVMNLYILLKNFYNINTIDLPEYYEDNFDIFFNIFYNFITYDIDVLRNYFLHLSITRNYKFGQNDSTKYITNIQNVGGNSNLLNLNGSDLANKLTSNNYMEKLINNFQQNMIKCKIITIDIIKIISERYQDESKTYILKMIYSLIDILYKEKDKTLLCHNYNCLSSTIKLIYHMHLEKSDLNPYIQVKFIEKIIETGSSTYKIKI

SEQ ID NO: 130 - protein, 958 aa, Plasmodium yoelii
MNDPNLKNMYALDEYKNGNFQIMSNLDHIEKRDFDINNVMLKGDTHGDGKVGSNNNSDETANNINNNSLENRDNASNMKGNKLSIYNLLVNAFNGGKKNTKSSGKEKRNNPTTVLGDESGINASSANNTSLNSNIDLRESINKDNKYIDHQSSMNMRNSENSDTLDISNNNASLLSHLKSGSGMDNSSISTHNIREGNMKGVNSKSGNNVTNSGNKMNKIEMMNSGKLGNENQRNKSNSPSHSHDSRNNSSLIMNHVNNKKYNIHKNDIDGKLSIDMLNNSEMELNNLLGTLPKNLNDNLSLYLENKRNNSSGMLPNESGISHFNQKFGKLEDDDNNNNNNSNGGQVVMINKEEHQRFVSLKSMLDTYRADVLNTCLLLEELILNQAMCKYIPTELYNKILKCYERLDMMLTDINNSNGDMGMKRTKDLNSLRSIGNLETMDYMNLNNMNINNVNLNDMDIKMDENMLYEDFKSYWDMAFSKNKIASQLSTKDLINNNQKNVLNPSQHQDFHINDVNNSNNNVLNKNGTINNKNNIHINQLFYDQGHGNKISNNNNHPIGNGGLNSSIKSSIGIMNTSRGSTNMIGNNNISLSEMSNNNNLGNSQMKSQKKKDSSNIMDTIISDNMNNSIGGCIGNSKSKKNSNDNMNDENNNHLNENMVLNYNNLKNSSIMNKKKFISNMNNNGGNNIDLVNFINSANNTIMKGNGMIGNNAAINSSILNGNNNVNMMNAKNSNTNYPADINSKLAKELNNYNSMNKERNMNHIEESDIKAVNKLLMLNNNNFPNLKVNNNNNDNILSDYSTNNATNNIMLNAETFFKKLNLYNDDHNNNVNNKNEGIGCDSNLLSLININRNSKSSYNVNQKGDNTNLQACNSHSEYDNEPRDNNNFKKQLNNENHLYNMQNKNMRNDINLKYLEEINSQFNFLPRNIRKENTEHNLMNILNFQNNLENKMQKQID

SEQ ID NO: 131 - protein, 458 aa, Plasmodium yoelii
MNALKKELKCMMMGRRNLGHSILKRGTNLSYKNIRSCQFFVEKKYLSIHEYLSIDLLRNNNIPCPQGFHAQTPEEAEEKALELQNICGDIDLVIKAQILSGGRGLGYFKENKFEGGVHICRNSMEIKDVASKMLNNTLVTKQTGPDGKKCNTVFICERFYIRKERYVAFLLDRNSDSICLLGSSVGGSSIEDISKKTPEAIYKININIKDGLTDGQSREFCEQIGFKGNELDMATDMVVNLYKIFKKYDCTLLEINPLSETNDGRVLCCDAKLNFDDNAEYRQKEIFEKRDLTQENPEELEAKKYNLNYVSLDGNIACMVNGAGLAMATLDLIVLHKGSPSNFLDVGGSATETEIAEALKIIDNNDKAKVCFINILGGIMRCDIIARGIINAAKQIKFKKPLIIRLEGTNEKEAIKIIEESKIKCIICQDMNLAAEKAVALAEIIEIAKRSNINIIVS

SEQ ID NO: 132 - protein, 568 aa, Plasmodium yoelii
MNPVQAENNAVEERIVSFEEEVETFLINLHDFVYHRNAEAIKKLFDTDFYTISDLYFKNIRWPSIKLVDLFYKQKNRYHNLIHSLYEELYYRHVFIINDVTLEDRKNTWENYKCLLNFISSICTDNDGNDNVLVMPNVWIYDFLSEYIYQFQSMCHFKIELLNFPEENTKGIEFVVNNPDVFESNIVLEVLHSLLLKGEFTTLPEDEKITYVNNIFNINNEELTSKYQFSYFSCCILLNVYVLLGDYYSALKIISNIQLNHKQLYWKVILCHINIYYNIAFCYMMLKRYNDSIKILSQILIYLSKQKAHISNQQKYQQSLINKLIDKMYLIAIICHSLCNTRLDETILQNIKENYSSKFYSLQSANEQAYTDLFYRVAPKFIDPVSNISFQLLTNFENTQNQPYNSNPTLRQLSIFLKNVTYQKKTYHLMSYVKLYHNIQINKLGNLMNYQEEDNDNVYCDIMCVKNYNRQLIWKEGPLYSGEITTSIFGNTFDFYIDIDILNIKTRAQQKFFIDYFIHQIGMCKNLTNNLHGNNSGHLYKIKYDNYKRKNKGKNRNKHANHQIPVMQ

SEQ ID NO: 133 - protein, 210 aa, Plasmodium yoelii
MKSNSKDSENKKVENLVLDDNDENTIIPYYLSNLLTNPSNPVVFMDINLGNNFLGKFKFELFQNIVPKTSENFRQFCTGEYKVNNLPVGYKNTIFHRVIKEFMIQGGDFINHNGSGSLSIYGEKFDDENFDIKHDKEGLLSMANSGPNTNGCQFFITTKKCEWLDGKNVVFGRIIDNDSLLLLKKIENVSVTPYIYKPKIPINVVECGEL

SEQ ID NO: 134 - protein, 317 aa, Plasmodium yoelii
MKNSWRHKALALPFLLLSSVLCNKTFFVDILNGINIKYNNKVPINKNVSNCYGQNNTKNDNRYSSMKQHFFIQNTAQPTIISETCDIENNNRNANILKQYIYTLSHLTIFDIDKETDIELNISLLLKACIASYNYIKNIEIYTSNVKNKEMCSFIYENRQDFEEYFNLQVLMYEKMFNPNENIEELLKSHIKDENIYKNDLKIYKQIKNNNIELKKDILEDILFESIRLNKMIQYSLTVNKFNLFSNPILFKLFLHFKTNGIYYDILLNIINKIKYYYSIKNINEEYKNKIFKIVDSYIAILNSIDDVYKKHDGNIL

SEQ ID NO: 135 - protein, 231 aa, Plasmodium yoelii
MSTPSIMVENENISQDKSEIVSKLVENKNTVCSWCFDILKNKLEKNKFNYIPPIIKDLHEKGFKIAFFVKWMKLNDIKDLGSYEYNAYDLKGCIGCLSQIDLTELQYYALESSLNDTRFNPITLKDLPYLIVTITYLFNFEKCEHVYDWVIGKHGIKINFTINNKRYSSTFLPDVATEHNFDHETTITHLIRKANYRGTINDQLLNIIQTERYQGVNCSLTYTDYEKIKQG

SEQ ID NO: 136 - protein, 619 aa, Plasmodium yoelii
MKISDVINDYKSLESNKLKNSDISSKKINNDSILEEFEIKNKIRKVCLGIPTKDLEVKNILRLLKEPICLFAEDNYDKRNRLKHILVTRYDKLIIKNKGENIEEVEEFKNILKKYYIDFSKIYDTTSPEYQKVNELEDELRNKGIKKDDATTKSGISDNILKEKFYTESTEELKLSRIDITLKTLPRIYLYKEMINNFQNKYSREQYENYISSYNEHIKSELDLYISQLGDSRPLTMGKFSPDNSVFAVSSYNTYINIFNFKNDNYNLVKTLKNGHVDKINCVEWNYPNNYSYYTTTNYTDINKNDLLLASCSSDKTFCIWKPFLHETNDGNNSSENYSNLSNKSDTNDNNDGKKGGKKKIEKNEKKNNSQEDANENDENGSEDINDNNNNVDNKEPLLCKIKAHDDRINKICFHPLNKFVLTCSEDETIKFFDIETQNELFYQEGHNSNVYSVTFNPYGNLYLSGDSKGGLMLWDIRTGRNIERKHMIHNNCIMNISFNPFMPNMFCTCSSDNTIKIFDLRKFQVSCNILAHNKIVTDAIFEPTYGRYIVSSSFDTYIKIWDTVNFYCTKILCNNDNKVRNVDISPDGNLISCTSFDRTWKLYKIEEFEKENIMSHFF

SEQ ID NO: 137 - protein, 1623 aa, Plasmodium yoelii
MICGKDVRLKNDDNEKKNKTQFKSNETNSYYSIDQNTISDGESPNICYVNKSDTTNLHINNLINNIIKCNNKFTKYNRIILSLKKINERIKCSNKCILNSCSEQQKDTKKKRKKNILQIKQRKNKKILFTNSCRISTKKKKKCNPKYELTEIIWKHKINKKIHQIIKRVIYITYCTNIGHYKKRNIRNNSFIYFLWNPHTLKQRNQEIKKQKKTTKLISSTNFTIINELKYNRGKQKYLNVERLNMVTDSKKGNQYNSKGEQNDKILYANKKGTNLMEEYGAEVEDKQNDEKQKCSETNYIYNSLEKQSENTYDLYKGLCKNSTYSGYPYGFKNSENKLAKRNKKKKSLISNIFNRIDDISDISGNNNDVILSSIKKNSKNFGKCNSEDNGNRIPMNEKHSNFCCNDNKSNNLKNYVYKDNVLKTSDHTYTCLSKFSNNKCTSNNIYFDKKLYFNKYNNTNNTDNLFDSKNVRNYSHSLRNIIKRDEHNDKKNNKLKNCIFSKINADNNNQFFLHKIDVLSDIHIHDKNNHSNCDHNGRKNWKSKKFNYFPMCLSIETDPINGYKHQYTKDSYIIKRTYSIDRKYNVRDYFRMSYIHNNYNSYKNRGNSTNYFSQNINCGNIESGQADRYFSRKKLIPNFLNKNKHNNDKKEIKYKNNVEKNVAFYYNSHYANKHNVNFLSYQNNNIYNKKLRNSMEDRGYSTNNSSSNATINEINHNNSASTRASNTNSSNNYTNGYTSVQPFKRLKNRVNNHFSALKRSYKNYQKNFEEEKIIFFNSIRNIIRIIKEIKKLKVDLKKEKKYCSVICDEKKREEFNNLIKYLLHQKIIRKKLKEYYFKKIDKGLFTFLLRSNYANFLFSEEEVKLLKRWNVIKKKRSKFDNDNNANHEENKAYDKNNKFQANDNLAYCYTDILNIQSPDQTNNFFGSEKERKTCYQEVPKNEKVLENNILNSEERKSYQNNYNRINQSYGNNNEFRFYTTNGFNHNTIEEYYKGNYLKQICINNLNDLYLKHCKKYKRSIIFNVLSFFKNIKIKNVSKKFKKKLKNNQHIYLSKIYNYKKMLRHIKYIFIKLLKKNIADINSIHINNCFLNSTICFFLFLILTIFKNISTLKVVQCHIYYSQFYISLYHIKNNNLKNLYFMCNHIIHCEIPDKDIYDYKYYKNCIIYFDLNYLKKKSKNNNKQGNKKHVEDIARSESIIYPLGQLENYQIDKIQTDHESNTKPHYGINKIIIKKNKKVIPFDKISFYDIFVAKKKNLNKETANDEHVTIKLSNLPNKEHKNNIISSNIEGKQKDILCWYDSISTAPPLLNTGEEDQNEEENNMNHIHTEIEKRENKYICDDTKFDSKINTYNIHSSSCSNENSSGNSVQASENYIYAFPRKGIEYFNLEKLRVLRLSSNKLGDDALIYLSSLIKKKKLNKLKILDLRWNNFTYKSLLSLLFALINNVKNDYKNNTISDLKKNKQTNKLKLRKLLLSGNNIDSSLYSSFLSGFCTCNYIVVVELDFSMNIIDNECFPITLKYFKHILNLQKRKKKNNNISGVYINLDHNSLKNSTYINKLMKILFKFPRNKKKYIKNKNMEQTNFIDQTGMVKQNILLSLQYNDIKNIDTNVEFHKYEQRIRF

SEQ ID NO: 138 - protein, 256 aa, Plasmodium yoelii
MRIFQIFQFEATSDMSSNIDSSFFSVGEIPNELQSSFDDISDYILVDESDLKRERLENTGSESNDTVATKDGTGKRGTHAQILKELKSSSFSEASKASSDQTNNNDNKKNGLCRTLGTEGRKRMLKLLRKAYKYNEECKVIMKNKNPPLSISYLPYFNLSMLWQLAEDFGVYNEALKIHRECIKKRTTNVRFKGNKNSGNYNIQDIAKNSKASKNEYMSDYLSSNVDTQGGEFYDSMNTTLQDDVQGKRKRKKNTF

SEQ ID NO: 139 - protein, 379 aa, Plasmodium yoelii
MIQRKLYFTLVILAVLSTIQIDTKWNKYVNAWFGRGEPEDDDYNHTKLYKVLEVDKYATTEEIKKAYRKLSKIYHPDKAKDKNSNTRFNEIAEAYEILGDEEKRRMYDNYGLNAAKNVESNKMDDDPSDHFNIYESFFGGGFRREEVKKAESLILPIELSLEQLYKGDIFSIYYTRDVKCLRSDDCIMKKKECSGKGYRTVTQQVAPGFIMQNKIRDDNCIDRGKAWDSKCSYCPNGLIEEKSIELTLEIEPGTKNNDKILFEKKGKQQIGHENGDLIFLVQTKNHKIYERKNNDLHQTYQISLKDALIGFSKDIHHISGTPIRITKNTVTFHNEVLKIQNKGMPIKNSSQYGNLYIKFMVQFPDKLTEKQKEAIVDLF

SEQ ID NO: 140 - protein, 296 aa, Plasmodium yoelii
MNSAAIEVITKLKKDDESNNKCFDCGTPNPDWVSVNHGIFLCINCSGVHRSLGVHISVVRSIKMDIFTDEQLKYMDKGGNKKFQTYLENYGINDFIPERKYRTKAADHYRQIIRSIVNNSNPPSPLPLDEGKHIINYGINENVNYSDNKNSNSNINNDQNFVNSINTTEILENVSATFSSLINKAQTMTTNTINNLNKNDIIETTKDTLINSGSWITEKTKQIAENVSENPWWEKGQSKIKDATQNASGWISSISSTVSRTNSSLFFSNNDNMNNNNESKPAPNTSNINGNSTNEA

SEQ ID NO: 141 - protein, 773 aa, Plasmodium yoelii
MKELLEDLFKIIELDEETESYLKERINDEKKKIVKNGVDYFYDLICPFSDKKLKKNVIAEIYKKHVNDVIKVTNENKNDNNNEKLTKSLNLKEYWEKNDVIGYYDPFLGIQEKQVNYNTSIPLSESIKINKEKQKQKEKQLSLFKEWVKNKIKIPSPVRVHNLLHCSDSNKSKTKIEKMNDIRIENFNLSIGQRNLLNDTTLKINVMNKYGLIGKNGIGKSTLLAKLARHEIENIKEDISIACIEQDLFLEDVTVLECVLMVDKIRHNLLKELEELELAKKQNDTKNSNDTKCDNLKDDTDEKIINIYEKLNSINYLEAEKEASKILCGLGFDSNLQKKKVNSLSGGMRMRLCLSRILFSNNDIILLDEPTNHLDIYTIQFLIDYIQKLNKTCIIVSHDRNFLNEVCTDIIHFHQKQLTYYSGNYDQFEKTRVEHLLQQQREHDSIELKKKHVQKFIDRFRYNSKRATLVQSRIKLLNKLPVVNLEKDETPFKFSFLEPFYVSSVLIRLRDVSFKNEMFKNLQIKKNANIIIADDFEDSNAKPIELSNDDENKKDTLTNNITGDYQFKHEFLFKNANFEVDMDSRIAICGVNGSGKTTLIKIILNLIDVFDGELYVSNKANIGYYSQYHVDSLNPVFNSIQQLQYNYSHKNIKEDEAIKYFNKFNIPTNILYEPIYVLSGGQKSKLALAILAYKNPNVLILDEPSNHLDIESVQALIVALSLYKGGIVLISHDTYLIKHVADEIYHINNITKEVVKIDYEFEKYTKLLLENKI

SEQ ID NO: 142 - protein, 327 aa, Plasmodium yoelii
MKRKYLCGHNRPLTHVNTNCDGDLLFTTGRDKKFILWNLADGNQIGLYECSGAVYNSDVTFDSKRVVCSSAANKIYIFDVYTGETLKVIDESGPVRFVEFNRDPLNQNRVIAAIDRLKADHKRFIKLYDLKSDTLIWKQEHESRCIQVRWCFFDKLILSAHENGEIVIWNSEDGHQIRKFQAHTKEVTNLSFDKDRMIMLSSSTDGTAILRDAVNFDIINEYKTDRPLNTCDISPLFRSENNPKNHIILAGGQAAEHVTTTATGEGKFQTLLYDIIHANELGSIKGHFGTVHSIKFLPHGDGFVSGGEDGFARIYHFDQDYFIGKYD

SEQ ID NO: 143 - protein, 207 aa, Plasmodium yoelii
MNENRSRDYDYLYKIILIGDSGVGKSCILLRFSDDHFTESYITTIGVDFRFRTLKVDDKVVKLQIWDTAGQERFRTITSAYYRGADGIIIIYDTTDRNSFLHINDWMAEINKYTNDDTCKLLVGNKFDCKDEIEVPTAEGESKAKELNIPFIETSAKDSLNVELAFTMITQELIKKKKKKNINSVNNNQTKVNLSSDDRDQSSLCSC

SEQ ID NO: 144 - protein, 170 aa, Plasmodium yoelii
MSRAKVFFDISIDNKNAGRIVFELFNDITPRTCENFKSLCVGDKVGSRGKNLHYKNSIFHRIIPQFMCQGGDITNGNGSGGESIYGRSFTDENFKMKHDTPGLLSMANAGPNTNSSQFFITLVPCPWLDGKHVVFGKVIEGMNVVRDMEREGSNSGYVKRPVVITNCGEL

SEQ ID NO: 145 - protein, 194 aa, Plasmodium yoelii
MVSAKSKILKSNPSDLEREIAQCLVDIELSASSDIKNETKEIKILSCDLIEVEKIKKKTILIYIPYKIYATYVRKIQRKLINELEKKTKKYVVLVAKRTILKSRQKTKSFKILPRSRTLTSVYDSVLEDIVSPSEIIGKRISMKADGKRVFKIMLDPKERQRDNIDEKLISFAAVYKKITKRDTIFSLPPSNEK

SEQ ID NO: 146 - protein, 309 aa, Plasmodium yoelii
MAEHLARIIGTEEDRVNCPFFWKIGACRHGDQCSRSHYKPNSAQTLVIRHMYDNPPMAVAIAEGQMVDDEVLDQAADHFEEFYEEVFDELMKYGEIEDMVVCDNIGDHIIGNVYIKYTHEDYAEKAVKELNGRFYAGKPLQIEYTPVTDFREARCRQFVDGQCRRGGYCNFMHIKHVPRTVKRRLHKRMYKKFPMYKKNKKSRDDSDGDHRYDRYRDRNNRDKNKRDKYGNNYNSSRRRHRSQSSNGQDDDNQRSHKYPKRENSLERREKIERWNKEREMKNSQKNNNENEDTTKVENHGDGDDDNTKE

SEQ ID NO: 147 - protein, 811 aa, Plasmodium yoelii
MSTGLSRLLEIGIFVGSFVLIWYLTGEKLFKKKRRIVKDNILLILRHLCFEIYKVLNESSKTTKQVYDMIKSDPNAAIDVSKLEEAILNQGYKKKIEDVEKQVLDKFNVTADDFYDELKNYDKDVDIQKSLNSIKKMYNESLLGFTPKLPSIDENISKDVIINLTNLIYKEKRKIYKAKIDSMIKQNEDFDADVTFSDPEFFDKLQKSTEHVEEQIINENSDLIPNLFTFKYLVNYYSNDITFVQKKKYLESKHGEKMIKILKIKKNKKQKKKSNKDYNSSVHTQSQISLPDHLNSDKNESSKSLNIIHDYDNKNKNIFDTNVEPTNFPDQISVEIKQNEHDINFETTKKGWGRSLNEIKPDNDQSVSFSSIPEEYINNIDDFSVNKEIDQDPQDSDITTNDNALEPKIIDSEENPEQSEKPHESDAPSEADVEVEAAVEVEAPVEAEAPVEAEAPVEAEAPVEVEGPVEVEGPVEAEVPVEAEVPVEAESPVEDEVPVESEVVVEAEAPVETEVPAESEVAVEVETESPAEAEVPIEAESPMEAESPVEVEAAVEVEVPVEAEVAVETEAPIESEAVIESEVPIEAESPVEVEAPVEAESPVEAESPVEAESPVEAESPVEAESPVEVEAPVEAESPVEVEAPVEDESPVEVEAPVEDESPVEVEAPVEDEIPVEVEAPIEVEAPVEAEAPVEVESPVEAESPVEAESPVEAESPVEAESPVEAESPVEAPVESEVPVEAAEAEDGKKTANDGEAASVENSEGNDKHSNGGQEVETATNSETGTENSYETKGSEAKKKKKSFRFLKKNKK

SEQ ID NO: 148 - protein, 111 aa, Plasmodium yoelii
MAMKYVAAYLMCVLGGNENPGKNEIKNVLSAVNAEVEEEVLGNLLDSLKGKSYHELISEGLKKLQNVGGGGAAAAAAPVAGDAGDSKKEEKKEEKEEEEEEEEDLGFSLFG

SEQ ID NO: 149 - protein, 491 aa, Plasmodium falciparum
MNEELEVDENAYDMLFSPLTPWPCLSFDYILEHPKHDALSEEEKKRRKENIDSGILNYPLEVCCVAGTQANKRELNQIYVIKWSNLNKLKNVDDEEGSSDNSEDNDSSDFDVDIDEENDDTINGNINNGIEKKEENNVNNKLNNNNNNNSKHKKNDKLKEKLQKNEDTHTHKKSSVICKAIKHKYGSINRTKICKKINSLVATWCDDSNIYIYDISDEIKNLEVRPYNEQIEKKPLHVFEKHTTEGFSLDWNPVHAAQLLTGDNNGNIYLWLPNNSGKWNYELLNLKNMYTTNDNNNNNNKYNQNKQQCSIEDIQWCKKGNGLGNVFAMCSCDKSISILDIRNKNANSTNKNIHIENAHTNDVNVIAWNENTEFLLASGGDDNIIKVWDIRNTNNAVAQLIFHKQPISSISWNFKDTYVLLASSLDNSISIWDLSVETESLEFTDSKYPDQLLFEHLNQKFITDAKFHPHYPGLVVSTSSENFNIFKPCNI

SEQ ID NO: 150 - protein, 462 aa, Plasmodium falciparum
MLKEFVKNVNVRNHRYISFYSLRNQSRLNDIDDETYNMLKSYKNKNDINLSLVHNIMPTYMKEYLSIDLNRNIFVNNKNIENLEYIALNSFNLQKKYWGCLISNVSLNNNKSIDDYFFIKLYGHFLKKECKILRINYCLEQNIENNVSNDIMQNLYNIINIKNRNEPNYDEIQKISNDFNPDIIYFDESNNPYNIDYDRFIKGLKNKNNKIHNKPIIITNMNNKANLISQNLINSPFTHSDIVFTYFNENFRAHNSFVIFYKKGYKCVNTDGHIIEYDYEKKLKYAFDDIYLNNIFFSFFTSFKLMKNEEFKEYVKQIKENTYILYKYINRKYFHIQYSQNNSFFNLNPSSCTFNIQEFYLLCNKLNIYFDILKDKSSNQKSFNIGTNNLTSLGLLTHDIKNVAEFFNESVVLYFYLKEKSKLTNMSFIQYIEDNSSASDIYSLAVDISSFISSYPSPYTNE

SEQ ID NO: 151 - protein, 362 aa, Plasmodium falciparum
MGRKKRKLNIDLKPFCYYCDREFDDEKILIQHQKAKHFKCLHCNRKLDMANGLVVHMMQVHKTNLKSVPNALPKRNDPELVIRGMNGVPTDIIEENLIKLKQKLGDKNIKRQQRVNWAQVTMAPTMEQFLKQAQMGNFSFPGFNSPVLPTNNNILTNTLDINNKSTLPNIPLYIPNTTSNINNINNINNLLQQPIGNNIIYPPKNSTLLNMPIPPINKNNINNHVVTNPNTFTPSNIPPNIAHKYSANINLLPTNINQHNPMYMPPGLYPPPIPPLNHPSIPPTHIPSSTYPTKMTPIQQKRPSTKWDVPEPSEGDPSILKHNKEDSTENKNEEPHKVSQDDDLKQNEQKDNQEKNHTQNCE

SEQ ID NO: 152 - protein, 161 aa, Plasmodium falciparum
MSDHEMYDNIDAGASQTYPVQAGAIKKNGHVMLKEHPCKVVDYSTSKTGKHGHAKAHIVGIDIFTGRKYEDICPTSHNMDVPVVKRTELQLIDITEDGFVSLLYDNGDTKDDLSLPKDTEGNLDEVAKQIRNLFDNGKSVLVSVLSACGQEKIIAAKELSS

SEQ ID NO: 153 - protein, 564 aa, Plasmodium falciparum
MVNKEEAQRLKELGNKCFQEGKYEEAVKYFSDAITNDPLDHVLYSNLSGAFASLGRFYEALESANKCISIKKDWPKGYIRKGCAEHGLRQLSNAEKTYLEGLKIDPNNKSLQDALSKVRNENMLENAQLIAHLNNIIENDPQLKSYKEENSNYPHELLNTIKSINSNPMNIRIILSTCHPKISEGVEKFFGFKFTGEGNDAEERQRQQREEEERRKKKEEEERKKKEEEEMKKQNRTPEQIQGDEHKLKGNEFYKQKKFDEALKEYEEAIQINPNDIMYHYNKAAVHIEMKNYDKAVETCLYAIENRYNFKAEFIQVAKLYNRLAISYINMKKYDLAIEAYRKSLVEDNNRATRNALKELERRKEKEEKEAYIDPDKAEEHKNKGNEYFKNNDFPNAKKEYDEAIRRNPNDAKLYSNRAAALTKLIEYPSALEDVMKAIELDPTFVKAYSRKGNLHFFMKDYYKALQAYNKGLELDPNNKECLEGYQRCAFKIDEMSKSEKVDEEQFKKSMADPEIQQIISDPQFQIILQKLNENPNSISEYIKDPKIFNGLQKLIAAGILKVR

SEQ ID NO: 154 - protein, 929 aa, Plasmodium falciparum
MSAIFNESELSGLDAHSAFGNNETSSFQKKKRRIDENSQMSVNDLVDDGEEEEDDDDDEEEPSYVQDQNMAKVFEKFLKTFSEKKSEEDDDDGDSIWKDSLNFDFPSNLEIAKDSHYVLLLFSILQNSYSRNKVLIVDMKHVLMWEPTDKNRFDIGSQLYMYIKRHFLRILDIFEKKVQLLAESINPIKTKEVGKICLRFYNKKNPIHSLRSLRCEMLGEMISVRGQVTRTSDVRPELTLAAFKCNECGNIINGVKQQFRYTQPSKCPSASCSNMSDWSLVLEQSYFVDWQKIRLQEIAQESPPGSMPRNMDVILRNDIVDSVHAGDRIIVTGCLIVVPDIPTLMKPGDVPRSVARQLLKKNENSLVSQGLTGIKGVGVQDLNHKLCIYACQIEKLNSSKKDNNFDEQTQVDINCEEILNCDDLKWLRDIAMHPNTIDILAECIAPKIWGNLEIKKGALLMMTGGVQKITSNCKLRGDINMCIVGDPGTAKSEILKYVESFAPRAIFTSGKGSTAAGLTAAVHRDPDQGDTVLEAGALMYADQGICCIDEFDKMDEKDRVAIHEAMEQQTISITKAGIQATLNARASVLAACNPKYGRYDTLKTFAQNVNIPAPLLSRFDLFYTMLDCIDIDKDTSIANHLVSMHCGEEAEKHLRANAGKLDSVKLEIYLELSKRVKPLLTDEAKYKLIQYYVSFRNIEYSPGAQRSMRMTVRQLESLIRLSEAVAKLKFSHFVDVKHVEIACSIFKASMKKISNEKEINLDEEFDKVNNSLMGNKVNKLDQETENTEQNKKITTIKASEYQYISAIIFEIIKEYEFNNNNESITQDQLIETYLQVYAKAESSEQVDEWIYKLKKIINRLINQDIKLLSETNEDDPEKVIIRIHPNYAGPIVEGVSNKNTYGYNTFKNYQTQEKAPEDDVDFQEEIDNF

SEQ ID NO: 155 - protein, 608 aa, Plasmodium falciparum
MLLVIWLNIFWFIPYYCFNYVLCVGNKNDMLFVKNKNLIYPYNDMNRIRRHKGVELSRKMVAENIQMRNMKSNNNSNNVHENNNIDHSNNYNNNLYLSCSNKKKGKDVQSLCAIKHGNVLIKNINEEEKEKGIKKNDTDKLESKNDNEHKNEENNFVFSYDKKLNNYSEFNIYMENNNIEEYISDVNISREEICTLYEDMYLGRLFENLVAKLYYNKRVNGFVHLYNGQEAVSTGIIKNLKNSDFVTSTYRDHVHALSKGVPAHKILNELYGNYYGSTNKGKGGSMHIYSKENNFIGGFGFIGEQIPIAVGLAYSILYKNEFHYNPKNTSFTSTKNKNNYIQENENMIHMNNSQNVDVVVCFLGDGTTNIGQFFESLNLASSYNLPIIFVIENNNWAIGMESSRSSSDDLMNNYSKGKAFNIDTFKVDGNDVLTIYKLAKKKIQQIRNRTSGPIIIEAITYRAKGHSLADPDELRIKEEKTSWKKRDPILFLSSYMKKYNLVQESYFEQVKKNTQTLLQQAELDAEQNTKKGEHIDICNVIQQNIFAPSKSTPYQSEYENYKQFDDISNDELKEYYQEVLKEIQRKKEKKKLDPNDKFDQKKLPLIID

SEQ ID NO: 156 - protein, 1342 aa, Plasmodium falciparum
MENQIEKDMISIFTQSVSSNFEDVKYSEEKINNLYNDSNKEEYIRILLKLIMYPYNENNENKNVYDSTLNRNVKVSMLISIKNFIKKSIHSNLENMELSTDMCIFIKHICLHVLLDINNEDIKSLQKYFFEILVNLLEFNICDDYDYLLFYIIILYINDYNYIDLVHIFNNEEKKKNQDAFKIIECIMLYIQNKEIFQNINQHNFFMEYNKILQNLETIKNIIINRNNSLNDDIINYINNTKRIYKSGDKYNLFMLNDALLYNISPEGGVPTLNNHNNNHNHNQNNNNNNNNNNGNYYDNLSGVTTTNFDFRGKGTISKDYNNNIKSIDTNTLFHNNIMNIFSNMDCNHFKKKYIALKIIRKIIKKYKNNDYVSKYDLKIILTHIEYPVTLYFIYLFNKLNEYTNYINLKLNTSTNNFNTSNNNMINDELNICFYNMNSILMNMHVFLKIFYNINMIDLPEYYEDNFDIFFNIFYTLLLYDEDILNNYYNHLHLIKTVLKGSAVAPAGALNNMNRSMSIMSTIHNNNNNNNNNNNNNNNNNNNNNNNNNNNNMKNTFGNTNVTLNDLLKCKEHFNQNLIKCKIMIIDVIKILSENYQDESKIYVIKLICSLIQILYKEKDKILLCHNYNCLSSSIKLIHHMNLEKNDLNPYKDKEFVEKVIERVLNHIRLKNIDIDEIIEADLEYFRHDLNNVNSFSIRSTSIYFLKTLCNNYFHLCFPILECKILTKDALLTLSSDGMDITNKSSGSILNMSNLNNTVSINKNDPCYEACNVEYKVQLIACLNHSNLTQNFYEHMIKDLMNQFLVTIKMKYNNMDVLCYNMENYNFESPQMNTSNNNNMINMNNNMNNNKCVWLRDDDMFNTPNCIYLLSILKYLLNNRNICTTNNALDIFLFLHFLLYNEKIMIHNYACLCINRIFNQILNENIYKILLESNMVQRILNRLLFLLKYNVHNKILNEYILITILRIFLIFTYKISDFYVMVLLMIDNIIKLIINDSHNPLFNHYLFELLTIIISLIYKSQVQQHIQQIEDVIITTFSQILQIYIHDFIPYVFQILSIIVDNTYTIQKIHIKILNHLYEMDLWKSTIGNVNGIICVLKSYFKKYNIFNDIIKNNMQQLFNIYHYCLSNKKLYTDSFQIILSIFTYLPLDSYESFLKPLFVLLFTFLQHYKNDIIKIKVVHSLSVFILKTNVAVFITTLDTIQDGLIFNVLKSLYLPILDKLINVNEKIIIFLALTKLLNHDKIRNEPFVVDILNSLNKNITSNELVLKKSKVQHLDVEKDEMDQNFEVTYVKLQMINNDNVNEMVLKNININDELKQNLYNQHFMQICHNNAFNTILQLFNN

SEQ ID NO: 157 - protein, 2221 aa, Plasmodium falciparum
MESYIRESKKLTLKSNKGKKLLRYLDISLNNKSLHDSHILELVKILKKIIKIVYNTYYCLNIDLSENYITCIGLKTLLKYILNYNENIGVNILKLYKNSIKDDGALLIKQLVYIQKIPMEELHLSHNLIQDNACKELLLSFVQAKKDSTYVYPRYDKYQNPYKHAQIPVWIRLEYNCIHNPKDILKEVEDCAKKKRGYKSNLIVCSALKSDKRCCPYKCLNASIRNTPIMHVYMFIHQKENIVNGKMKEEKNDFVSLEGVLDKNEKSNFNNDKNADENMIKLDSSKLGNKNKFKNENDEFEEEEEEIDVDDVDDVDDVDDVDDVDDVDDVDDDEDDEDDEDDEDDDEDDDEDDDDDEDEDDDDDEDEDDDEDDDDDEDYDDDDDEDYDEDEDDDDENYNLKDKNNLKGFENNKRIKGNKKGSEKPFVVNKEMVVENKNKNINNEEDEKNIDKKKSMNKKKRKKKKKRVNNYNNNNNINNNNNNNSNNKKKSNLVKDKKNSSTSTCNKFMNNTHNLNKSFSNIASDMYNKDTNMSSLNTSENTLPLYIILDCSAVLDMKELWKDKSILPFSFPGLLYLYNNKLLKANTIGNNNIHMNSNNNNNNNNNNNNNNNNNNNNNNNNNNNNNNNNNNNNNNSSSGNNNTNKPGNDNFICLMCSYVANELKMVCQKSEIIRQKMINLKLNIWDKLSELGIIEFLSVPKDFKENKKNFLNSSFLTDEQIKLANEYYDISYETLQMIQFSIVWSTYIFKISNKEIIIENNKKEINKSDMKKSKKTIFTEVLYLTSSSNIYSFFEYLYEQDINFILPLCVTVNQINKYIQDEHSYIIDILMNNAKADKYGKLQFNKSFFQQFIKEKYSKYLYTNTKEEIINDKKKQSKSTLCNTKPLSCDILEQVNEEQQMFNSIKNKDGILSSQNNLQNNNGSEYLIDDGMGTMRISDDMLNNSNDIKKKKNNNNKKFSSVQQMVDNKSVAQPILSHNNNNNNNVNSINNNNNSYDIYDIISVKSFSNDNVNNMCNVDKMMNVHNNIVSSKNMKEDELLKEHHLYLKKGSEVVPNNQYYNLGEYNKLNLQMLNITDLDILEKRTDINDIFNNSLSETNKSANNTTTNNNNNNNNIHNNIHNNIHNNIHNNGAVRTNPVSSENHLILDNRNNKKKTDMLENMLYCSTVESKLMGLNKNKMEANLDMNNDNINNDNINNDHLNNDNINNVARGHTVDSELTTEDPVIQKKGVCKDKSGTPSDNKVSIYELLINAFNGKKKNVTKNVNEKNKNGVNEEGVGLMNDANCNTNNMNNVDNTNNVDNTDKLDNTDNLDNTNNVDNTNNVDNTNNVDNTNNMNNNNNMNRDDKDQSILMSQIKLKNDHRIEEEELQLKGKTNHKDNVINEKRKSMVEKKSISLHKNVNNNDNLAFLNNQQDDNVSHANHTRSTIHKMSVFHNNNMSNIPSGCAMQNDEDNMVLLGNENMLFKKGGSIMNFGDVDNNTTCAMNKNERRLTNNMKSGHNIIADNKDEELLNVEKINNGELLHIGKNICSEQLINQRKVVEWKHSFENHKVDIVNTSMLLEELILNPTVCKYVPGELYNRILKCYEKLDFMITNLNNINEEMETMKNVYNTEGNNNKNNNNNNNNEHGEHNIDNIVNKNVRTSLLKNDNIKTTTTERNNSINHSMNKNDVSMMYDDFKNYWDSPLGKNNSINNLMMMNNSINNINSGFNSMNLTASELMKSLSNGIHLNQKMNTLTSSLPHDFLLNNNMLGSMTNNNNNSNNNNNNNNSNNNNNSNNNNNSNNNNINLGMTTPLNNANIIQNHLNNSMLKNNMVNKNSAHNLASHLNNNNKVSKKKSTLSTYNNNMNEGNNSMNLNMNMNSTNNLNSSSVMMMLMNSAQNNSIQKKYINNNNNNNNNNNSNSNNNSSNSNNNNDMTVLLNNMNDVRINPNVLLNNNNLFFQGNNYKKDESNTGNKMSKDMNVINNAHANVEIMKNDNMSNNNSSNNNFVVGRDLKDIKTLNKILLLNNSNLNSVKGVSLNEKQLLNYINNNNNNSSSSSNNNMSGIPSVNSNIDTNLLTLLNMTKNNNNNNNNNNNNNNYINNIGSGINSTGISNKNLMINHQNAKNNNHNNNNNDKFKGNPFNDFNGIVTSNNIKKILNNENNNNNNLYMMNNNKTPINDINVKYVEALNSQFNFLSRDSRKIDTENNAINILNFSNDLEKKSNNTMVDICEKTNDKKI

SEQ ID NO: 158 - protein, 462 aa, Plasmodium falciparum
MARFKSQFNFMLKFKRHIGNKIIWGRTNNFFYKKEYIFSSFRNNIGKRYLSIHEYLSVDLLRSHNVPCPEGYAAKTAEEAEEKALLLQNVCGDNDLVIKAQVLSGGRGVGYFKENNFEGGVHVCRNSMEVKEIATKMLNNTLITKQSGPEGKKCNTVFICERFYIRKERYIAFLLDRNSDGIILLGSSIGGSSIEDIIKKNPDAIYKLNIDINNGLTTGQAREFSENIGFKNDQLNIVTDMIVNLYKVFKKYDCTLLEINPLSELNDGRVLCCDAKLNFDDNAEYRQKNIFEKRDLTQENKEELLAKKYNLNYVSLNGNIACMVNGAGLAMATLDLIILHKGNPSNFLDVGGGATEEEITEALKIINNNENAKICFINILGGIMRCDIIANGIINAFKQVKFNKPIIIRLEGTNQEQAHEIIKNSNIKCIVCQDMNIAAQKSVAMAKIIEIAERENIDISFN

SEQ ID NO: 159 - protein, 656 aa, Plasmodium falciparum
MAEVSPVEENVIEEIVSFEEEVETFLINLHDFVYHRNAEAIKKLFDTDFYTISEIYFKNIRWPSIKLVDIFYKQKNRFHNLIHSLYEELYYRHVFIIKDITLEDRKNSWDNYKCLLNFITTICTDLSGDSNDNVLVMPNVWIYDFLSEYIYQYQSMCHYRLQLLKDLEKNEEGILFVTRNTEVFESSIVFEVLHNLLLKGEFSTLPLEEKSTFVNNIYNINNEEINSKYQFAYFACCILLNLYVLIGDYYTALKIISNIELNHKALYWKVTLCHLSIFYNIAFSYMMLKRYNDSIKVLSQILIYLSKQKIHVSNQQKYQQNLIHKLIDKMYLIIIICHSLTNTRLDETILQNIKENYSGKFYALQSANEQTYAELFIRVAPKFIDPLSNISFQILSNFQNIQNQTYSSDPTNRQLAIFLKDVSYQKKAFYFISYAKLYHNIQLKKLANLMNYNELINNDDEHEQEQNVSSDIMCVKNCSKQLIWKEGPLYTGDIINSIFGNSFDFFIDLDIVNIKTRAHQKIFIDYFVHQINMSKNLMNNLLGAASTHMYKTKYDNFRKKLKNKTRNKHNNNNNNNNNNNNNNNNNNNNNNNNNNNNNNNNYYYYHKNKQNKQDKQDKQNKLNRQNKQNKQNHLNRHNNQNKPNHQNNMHAQVAAS

SEQ ID NO: 160 - protein, 217 aa, Plasmodium falciparum
MKNLNQNMKNNDNKKNEKISGLEENEEHNNNNIVPYYLSNLLTNPSNPVVFMDINLGNHFLGKFKFELFQNIVPRTSENFRKFCTGEHKINNLPVGYKNTTFHRVIKDFMIQGGDFVNYNGSGCISIYGEHFDDENFDIKHDKEGLLSMANTGPNTNGCQFFIITKKCEWLDGKNVVFGRIIDNDSLILLKKIENVSVTPYIYKPKIAINIVECGEL

SEQ ID NO: 161 - protein, 314 aa, Plasmodium falciparum
MMIKNFYKFFILYSLFMTCLTKKMLFINFFNEINVNYNKKKDINKICMNRLTNTNKGYTTNKEYISNNAQKNICTINYGQTYSNILNDEEKEKILQQYIYTLSHLSIIDIDREKDISLNISLLLKACLASHNYIKNVEIYTSQIKNQDICSFIYENRTDFEDFVNTHILKYIEFFNKDKIEDTLQSYIKDKILYDNELNIFNIIKNNNIELRKDILQDISFECIRLNKIIQYSLAVNKLDLFSYHIIFKIFMYFKTDQFYYHLFLNNIQKIKYYYSIKNITDQHKEIIYKIVDKYLYIIHYMNNMYQNRDIKNV

SEQ ID NO: 162 - protein, 238 aa, Plasmodium falciparum
MNETLKSSSDRNMINQNKANVVDELVKRKDEICSWCFDTLYYELKNEKYDYVPPILQKLHKGGFQIPIFVKWMKLYDKKDMGSYDYDAYELKGCIGCLADVDILEISYYAIQSSLHDTRFLPITLKDLPYLIVSITYLYNFEDCKHVYDWVIGKHGIKINFTINQKKYSATFLPEVAIQHNFNHETTVKKLIRKANYRGEINEELLNIIQVQRYEGISSSLTYQDYQKFKSSQNKRNA

SEQ ID NO: 163 - protein, 648 aa, Plasmodium falciparum
MKIGDVLHDYKLYDNTKKKSSEMVINENDNKERLLEEFEIRSKVRKVCLGIPTQDIDVKNILRLLKEPICLFGEDSYDKRKRLKNILITKYDRLIIKKKIEEEDDVEEFKNILKRYYIDFSDLYPSGLSEANKINEVHDKHKLKDVHDTKEEQNVHMKTVREEDKDILKEKCYTEGTKDLKKSRIEITIKTLPRIFLYKEMINKFQNGYSKKEYENYITSFNEHIKKESDLYVSQLGDDRPLTMGKFSPDNSVFAISSFNSYINIFNYRNDDYNLIKTLKNGHEEKINCIEWNYPNNYSYYSTMNYKDLSKHDLLLASCSSDKSFCIWKPFYDEYDDTNDNINDNINEYINENINENINENINENINDNISDNTSDTISDNINDNINDNISDSISDNISDNKNNNSHKVDKYNSNKNKLSAQNKNYLLCKVNAHDDRINKICFHPLNKYVLTCSDDETIKMFDIETQQELFYQEGHNTTVYSIAFNPYGNLYISGDSKGGLMLWDIRTGKNVEQIKMAHNNSIMNINFNPFLANMFCTCSTDNTIKIFDLRKFQISCNILAHNKIVTDALFEPTYGRYIVSSSFDTFIKIWDSVNFYCTKILCNNNNKVRNVDIAPDGSFISSTSFDRTWKLYKNKEYTQDNILSHFM

SEQ ID NO: 164 - protein, 1844 aa, Plasmodium falciparum
MNSNNFILSVYNQKIKNINNISESDETNSYHSFDTYSKSEEENNTHIFNDRTHKYQIDYLKNLLNNFIEKSNDFYIYKKIILSLKRVNEKFPFPKCYYYTAKLGSKKRKNKKINIYKNIYNKSNNNIYSNNNIYSNNNIYSNNNRYSNNNSCSNNNCSKIKFPRLCSSSSSFLASYNTYNKKQIGKIKKYRTIRYIKSIIQRIKYEIIFNNPQNCKRQNKIENKSKRNIYHLVWILKKKKKNSYLGTNWSCVHKKKKKKKNLSIRKIKKRISLNFVNYDMKSTTIENCADEQHCNMEEEEVEQIKDECNIKHLKQNDNKINVNQNEQEKFYPYDNINEEEISHPYNLYTNNENYEEKKKKTSNNLTAQNEDIVQEKIHTPFGGDNYNQELEENINKSNIISNNEIYTYNINNSFSIYKNVGNTYDNNINDIQNNKTYVKNNDDQYNVDNNNNNVDNNNNVDNNNNVDDNNNMDDNNNMDNNNNVNNNNNVNNNNNVNNNNNVNNNNNIYNKKNNIIEYMKNPCNYNICFPNIMTNNILSEDAYEENLTTPKKIVKKKQLNACCTFNIPSNSNSTLFYSNQSKMFYRPSNIYLDPMMDSSYVYWNEQDWVTRENNKNNDNYNENYKRDYFMNTTKTDTHNILNTNNINGIYNSSSFYNNNNEVNYQVEENKNNKRHNINDHKTSFHYNNFVLPYPYESNTQHISSTYNKYVQHVHMKRDEKGSIPYNMFKDDNNKENFYIHDNNKYTIYDKNKYHNKYTYTNKLPSVPFKSLKSNLDEQKYLSTGILQKDKNSFENVKNSFEEEKKNFEKVKNSFEKEKNVFFHSIQNVLCLKKEIKKIKINLNNQRKYTFLHMDEKKKNELDNLIGYLMYQKMIRKKLKEYYFNKINKAFFTFLLRSNHANFSFSPHEVMLLKKWNLLKFKQARKNHILRNIKKNTQTDYSHDSQKVVTTPRQEQEQEHNEKIVDNISISFPVTNNNIVFKPLNEYMRKKYDVNNLKKTEQRDNIIRYDDQNRRTLDNNNNNNNKKVNNTIYKEKDNIYVDDSLLNNNEHSLLKSNNILSYLSTHRIIYMKKKKKDLNCNHLNEDNDYSNNKFLQIPSESFYELYDQNKTNIFDVFLFLKNIGYKNVQKSFKKKLKKKYIYLSKINNCNKMLSHIKYLFVKLLRNQIKDIIGIYINDCFINSTICFFLSLILFIFKNIHTIKIIRSHIYLSYFNIFLDYFRNNNLKCMYFICNNILYDLMIEMDTRSNNDNNETSEYKNDEILINNNIYNKNMCDNDYQPKRYKNFLIYFNQNYIKKRKNKKRNDISIHNNKRDQGGKQLVQQCEENTEKKYMQEQKININNSEQGKEKKIHKRRKKKYKIIIRKDKCKKYFISTCEENKIVYKKKKKTIFFDDYGFYNYFTKKKKKNKKKKQNQQIGNDNKENINGAQLTNNNNDGMEKALDHDTNYKKNEKMNKQKKKNNNNNNKMERKQSKLQQFINKLKMKKGNDSTTKDYDNNNNINDDKKNINDDNNNNNIYDNNINIYDDNNNFNDDGRGNHINKYNIHSSSNNQSCISLDTLDGNSYDTYSHNIPKKHLYYLDLNKLEILKLCSNKLDDDALIYISNLIKKNKLNNLKVLDLRWNNFTYKSLLTLSFSLTNIIIKNKSTNNHIIKNQKEQKEERNKKIQLRKLLLSGNNINSSLYSSFLSSFCTCNYVVVKNLDFSMNKIDNDGLYITYKYLQHIKKIQEKKKLAMFKRNQIYKEYEKLTPNQKEILHMQKKIKNKKNKLCNIYINLDHNNLKNSVYINKINKLLNNFPIQNYKKKKFKKHTNHNNQHVILSMQYNNIKNVYTNQENIKQKHRIQI

SEQ ID NO: 165 - protein, 275 aa, Plasmodium falciparum
MKMELLNIKNNDNIPLGSMRYTDLSYGCESELSSNEESPFFSVGDFTNELHSSFDDISDYILVDESDLKRDRSENTTGSESNVMIASMRVDDKRVGNEKIKKELKSFSYSEESKTCSDNTHNEDGSKKQNFSRTLGTEGRKRMLKLLRRAYKYNDECKIIMKNKNPPLSISFLPYFNLSMLWQLAEDFGVYNEALKIHRECIKKRNASVKLKASAKASANYNLQDITKVSKNSKTEYASDIASNADMNTAEDYDMTNGSINEDGQGKRKRKKISF

SEQ ID NO: 166 - protein, 380 aa, Plasmodium falciparum
MINRKVCLLFLAVFFVLTIFKKLLKWEIFIEAWYTQEETDDDYDRMKLYDVLGVDKNASSDDIKKSYRKLSKKYHPDKAKDKNSNNKFSEIAEAYEILGDEEKRKIYDRYGLEAAKNMESNKMDEDPSDHFNIYERFFGAGFKREEEIKKADSLILNIEINLEQLYNGEFFSVMYTRDVKCLRSDDCIERKKECSGKGYKTITQQVAPGFIMQNKIKDDECIDRGKAWNKKCTYCPNGMKEEKTIELTLEIEKGMKNNDKIVFEKKGKQEIGYENGDIIFIVQTKKHKIYERVNNDLHQIYEISLKDALIGFSKNLEHISGKPININKQNVTFHNEVLRVQNKGMPIKNSNKFGDLYIKFLIQFPKQLTDEQKKVLADLL

SEQ ID NO: 167 - protein, 332 aa, Plasmodium falciparum
MNAAAVELINRLKKEDESNNKCFDCGISNPDWVSVNHGIFLCINCSGVHRSLGVHISIVRSIKMDIFTDEQLKYIDKGGNKKCQTYLENYGISDFIPERKYRTKAADHYRKILRSIVHNVDPPAPLPLDEGKSLINYGRNENVNENNKNQYSNEEPDFISSLNTSEIIENVSATFSNLINKASSMTTNTINNLNTNDLIESTKGTIINSGSWFTEKTKKIAENVSDNPWWAKGQSKIKDVTQNASGWISTISSTVSRTNSNFFFSNNDTNINNGNNEDINNNNTNVNSNGNTTNNNNEQAQNNNNVNFNYNSSNANNEYLNYGMNENNSTFN

SEQ ID NO: 168 - protein, 815 aa, Plasmodium falciparum
MMEELFKILFELVKIGDEEIQNYLKERIIDEKYEIEKNGVDYFYDLVCSYADDKIKRSKIANIFNKHFKNDNIQNGSNPNNIPNQHVLSIQNNKNLEKLEEVFNFKEYWKDKDMSNYSDPFLGVYEKQINYNTSVPISESLKISKEKEKQKQKQLNLFKEWVKNKPKIPQPVRVHNLLHCSDVGKNKTKIDKLYDIRIDNFNISIGQRSLLSDTTLKINVMNKYGLIGKNGIGKSTLLAKLARYEIEEIKKDISIACIEQELCLENVTVLESVLMVDKLRHDLLLELEQLEARKIKLDPNEEILSNETEEKNTQKNDTKNNKHNKNNKNVENMEPIETVESIEQKILDIYEKLNSISYLEAEKEASKILCGLGFDSNLQKKKVNSLSGGMKMRLCLSRILFSNNDIILLDEPTNHLDIYTIQFLIDYIKKLNKTCIIVSHDRDFLNEVCTDIIHFHNHQLTYYSGNYDQFEKTRIEHLLQQQREHDSLELKKKHVQKFIDRFRYNSKRAALVQSRIKLLNKLPVVNLEKEDTPFSFSFLEPFYMSNVLIKLKNVSFRNKMFTNLRVRKNKNILIGDHENETNEETYEDENELDNNGQPVSKTYEDKYKFKHEYLFKNASFEVDMDSRIAICGVNGSGKTTLIKIILNLITVYEGELHVSNKANIGYYSQYHVDCLNPIYNSIQQLQYTYSNKNIKEEEAIKYFNKFNIPTNILYEPIYVLSGGQKSKLALAILAYKNPNVLILDEPSNHLDIESVQALIVALNMYKGGLIIISHDTYLIKHVADEIYHINNITKELVKIDYEFDKYTQLLLNNKI

SEQ ID NO: 169 - protein, 327 aa, Plasmodium falciparum
MKRKYLSGHNRPLTHVNTNYDGDLLFTTGRDKKFILWRVSDGTQIGLYECSGAVYNSDVTYDSKRIVCSSAANKVYLFDVYTGEPLKIIEENGPVRFVEFNKDPLNQDKIVVAHDRLKSDHKRSIKLYDLKSDNLIWKQDHESRCIQVRWCFFDKLILSAHENGEIVVWNAEDGHLIRKFQAHSKEVTNLSFDKDRMLMLSSSLDGTAKLRDGVNFEIINEYKTDRPLNTCDISPLFKNENNPKNHIILAGGQAAEHVTTTASGEGKFQTLLYDIIHSNELGSIKGHFGPVHSIKFLPHGDGFVSGGEDGFARIYHFDNDYFIGKYD

SEQ ID NO: 170 - protein, 207 aa, Plasmodium falciparum
MTENRSRDYDYLYKIILIGDSGVGKSCILLRFSDDHFTESYITTIGVDFRFRTIKVDDKIVKLQIWDTAGQERFRTITSAYYRGADGIIIIYDTTDRNSFLHINDWMNEINKYTNEDTCKLLVGNKADCKDDIEITTMEGQNKAKELNISFIETSAKDATNVELAFTMITQELIKKKKKKNFTSLKNNHAKLKLSTHDNSPQSFCSC

SEQ ID NO: 171 - protein, 171 aa, Plasmodium falciparum
MSKRSKVFFDISIDNSNAGRIIFELFSDITPRTCENFRALCTGEKIGSRGKNLHYKNSIFHRIIPQFMCQGGDITNGNGSGGESIYGRSFTDENFNMKHDQPGLLSMANAGPNTNSSQFFITLVPCPWLDGKHVVFGKVIEGMNVVREMEKEGAKSGYVKRSVVITDCGEL

SEQ ID NO: 172 - protein, 194 aa, Plasmodium falciparum
MDAVQKRVLKSNPSDLEKEIAQCLLDIELSSSSDIKTDAKEIKLLSCDLIEVEKLKKKTILIYIPYKIYTTYVRKIQRKLINELEKKTKKYVVLVAKRTILKGKQKNKSFKIIPRSRTLTSVYDSILEDIVSPSEIIGKRISMKADGKRVFKIMLDSKERQRDNIEEKLISFAAVYKKITRRDAVFSLPPTNEK

SEQ ID NO: 173 - protein, 294 aa, Plasmodium falciparum
MAEHLARIIGTEEDRVNCPFFWKIGACRHGDQCSRSHYKPNCAQTLVIRHMYDNPPIAVAIAEGQMVEDEVLDKAADHFEEFYEEVFDELMKYGEIEDMVVCDNIGDHIIGNVYIKYTHEDYAEKAVNELNGRFYAGKPLQIEYTPVTDFREARCRQFVEGQCRRGGYCNFMHIKHVPRTVKRKLFRRMYKKYPEYKKRRARKDDSDDDGRRESYREGKDKYKRDRRSSHHYSSKRKNRSDNEDDDDDEERSYKHARRENSAERREKIERWNKEREMKNMNKEDNKSNADEKED

SEQ ID NO: 174 - protein, 1188 aa, Plasmodium falciparum
MNKGLSKILELGFFVGSFFFIWYITGEKIFKRKKKIVKENILLILRNLCYEIYTVLCETSKTTKHVYDMLKNESNTTIELSRLEEVLLNNGYKKKIEDVEKNVLKRFNVSVEDFYEELKNYEKDPDVQKYLNSIKKMYNEALLGLQPKLPSIDEKISEDVIINLTSLIYKEKRKIYKTKIDSMLKNNEIIDIQNTLSNAQFFENLHKSTQHVEEQIIKENNNLVPNLFTFKYLVSYYSNDPNFLQKKKYLESKHGEKMIKILKIKTSKKKKKRAHKEDRQSSNSSVSFKSTPSLDVYNVPHLGTLEKEEDHYSQQSKEMEHMDKDSHVDFIPHNVDANLDKRDEQIEYISESGDMQPEKEYYEGEHITIRYEEEEDISEIYEEDRASRIYEEDRASGIYEEEHASGIYEEDHEERYRTSQVSERSIKKSVTSQQDDIIHSHEEDNYVSDREVIHDDSFVGDKDQIFDDNYVSEREEIKQDDDYISEREEIKQDDDYISEREEIKQDDDYISEREEFKQDESFVGDKDQIFEDDNYVSEREEIKQDDDYISEREEIKQDDDYVNEREEIKQDDDYVSEREEIKQDESFVGDKDQIFEDDNYVSEREESKQDESFVGDKDQVFDDDYVSEREEIKQDDDYVSEREEIKQDESFVGDKDQIFEDDNYVSEREEFKQDESFVGDKDQNFDDDYVSEREDIKQDDDYISERDEIKQDDSFAGDKDQNFEDDNYVSEKEEIIYDNNNISDREQVIQDDNYVSDKEEIIYDNNNNNNISDSEVDKENNNYVYENDEIIKDNKSMNEKDSSIHYDEEGTVKNKDIIENVKEENSDIQMLENDIINNINNEIIDNNENEIINNQSKVENNTSMTEYEDVIDMDYKSPENLFMFDQEYNINEDHKGEINNNDNDNSKSVSGMGEREVSNEENREDEMIRNEEVDYIKDDDEHNTDDIKEDDEHNADDIKEDDEHNVDDIKEDDENNADDIKEDDEHNADDIKEDDEHNTDDIKEDDEHNTDDIKEDDEHNADDIKEDDENNADDIKEDDEHNTDDIKEDDEHNTDDIKEDDEHNADDIKDDEHNTDDIKDDEHNTDDIKDDEHNADDIKDEDNDQVEDNQELNENLEGSDVPKDDEALNIEDTSEEQKETDDKIESGSVRDKKNEGSTEKKIETKKGGLLMGIMKRKRFMSRDPKKKS

SEQ ID NO: 175 - protein, 112 aa, Plasmodium falciparum
MAMKYVAAYLMCVLGGNENPSTKEVKNVLGAVNADVEDEVLNNFIDSLKGKSCHELITDGLKKLQNIGGGVAAAPAGAAAVETAEAKKEDKKEEKKEEEEEEEDDLGFSLFG

SEQ ID NO: 176 - protein, 458 aa, Plasmodium vivax
MDGELDVDEEAYDMLFSPVTPWPCLSLDFVLSRPGGGQPPVGEAKKKGRDKGGRFPLAYPLQITCVAGSQAATGSQNEIYLLRWDNLNRLGGGEESGEESSEESGNSGQSDDGNHLGGHGEKKQTGAPPPRLARKKEHVVCKAIKHPHGGLNRIKTCKKINSLIATWCEDGNVYVYEMSEEIRHLDERPYHEELVKKPLHVFEGHTTEGFSLDWNPVHAAKLLSGDNEGNLFLWLPDNEVKWTYERLSIESGTQQKGDRSDGKAKGRKKHTIEDVQWSKGGNGFGHVFAMCSSDRSVSIIDTRDLKKDNQKREGRNGTHLHIADAHAADVNVLSWNENVPFLIASGGDDSIVKIWDIRNASNPVAELKFHKQPISAVSWDHSDTYVVLAASLDNSISIWDLSVETESLEFGLTKHPDQLLFEHLNQKFITDAKFHPLHPGLVVSTSSNKFNIFKPCNV

SEQ ID NO: 177 - protein, 470 aa, Plasmodium vivax
MIMASFHPRGALGFIAPYLRAFSPVEGRRCITYQSLRNQGSLKSVDDEAFNLLSSHYKNGNCLNLSVSNNIIPKYVRDYFSLDLNKSLSFDVSHLKLIEDMALSLFHLEPKYWGCTFGVNSTGDYPPGEEDIPFLFTLFRSLINCKGRIMNISFALAEEGEANNPLIENHYDCVNVKLKDKVDYDEIHKIYDAFNPHLVHVDETNNPHNFNYDFFSSLKDINKCVVVANISNKGSLISQDFIPSPFNHSDVVYTYFNENMRAHNCHVIFYKRGYKQVDKEGKLIHYEYEKKLKNQFLPIRVNNTIFSFLTSFKMMKNAEFKEYVIQSKENTRALLSHLNKNFFNIQYAQNGNFLNLNCTVPPFNVYEFHEFCKQLNIFFDILNPFKYTQKSFNVGANYLTSMGLLEGDMKTVAEFLNRALSLYLSAKRQTNCAGNEFVQFLKRTCVTSPSMLSLSNDIFCFISSFPDVHS

SEQ ID NO: 178 - protein, 366 aa, Plasmodium vivax
MGRKKRKINIELKPFCYYCDREFDDEKVLIQHQKAKHFKCLQCNRKLDVASGLVIHMMQVHKSNLKTVPNALPKRNDPEIIIRGMDGVPPEIIEENLSKLKQKLGDKNIKRQQRVNWAQVAMAPTMEQFLQQAQMGNFSFPGFNSPLLPTNNLLPNGPPDSKKKNIPPMPLFLPNNFNMMQPPPLGANMYPPVNQQNASMPNMPPPHMPSSMTPPNAPSSGPAGFPPNIPTLPPGSAQKYPPNVNFPGSAFPQNLSPNMFQPPPHSMYMPPGLGQPPVPPSAPPMMPPAIPPSAPPGMAPHQPLNPDDVDAKLEAGAPDGENSSPTKSDTKNEHKDVSSNHGEIANQGQPHSADENENPGGSDSGK

SEQ ID NO: 179 - protein, 161 aa, Plasmodium vivax
MSDHETYDNIDAGASQTYPVQAGAIKKNGHVMLKEHPCKVVDYSTSKTGKHGHAKAHIVGIDIFTGKKYEDICPTSHNMDVPVVKRTELQLIDITEDGFVSLLYDNGETKDDLSLPKDSDGNPDDVAKQIRTLFDGGKSVLVSVLSACGQEKIIAVKELSS

SEQ ID NO: 180 - protein, 559 aa, Plasmodium vivax
MTNKEEALRLKEIGNKCFQEGKFDEAVTHFSNAIKNDPQDHVLHSNLSGAYASMGRFYEALESANKCISLKKDWPKGYIRKGCAEHGLRQLDSSEKTYLEGLQIDPNNKSLKDALENVRKEKAAENMEYINHINTIIQNDANLKAYKEENQNYPNELLNTIKAINANPMNIRYILSSCDRKISEGVEKFFGIRFNEDAAYNEERQRRMEEEEMKKKKQQEKEEEERKKKNRSPEEIQGDEHKQKGNEFYKQKKFEEALNEYDQAIQINPNDIMYHYNKAAVYIEMKQLDKAIETCLYAIENRYNFKADFAQVAKVYNRLAISYANLKNYDKAIEAYRKSLVEDNNRATRNALKELERKKEKEEREAYIDPEKAEEHKNKGNEYFKNNDYPNAKKEYDEAIRRNPNDAKLYSNRAAALTKLIEYPSALEDVMKALELDPNFVKAYSRKGNLHFFMKDYYKALQAYNKGLELDPNNKECLEGYQRCVYKIDEMSKSEKVDEEQFKKSMADPEIQQIISDPQFQIILQRLNENPNSISEYIKDPKIFNGLQKLIAAGILKVR

SEQ ID NO: 181 - protein, 944 aa, Plasmodium vivax
MSGMFNESELSGLDAHSVFGNNEASSYQKKKRKYDENSNLGTNDVMQEEEEGEAEEDDEEDDEEDDEPSYVQDENMAKVFEKFLKTFSERKSDEENEDDEDGDNDSVWKDNLNLNFPSSLEIAKDAHYVLLLFSILQNSYSRNKVLVVDMKHVLMWEPTDKNRFDIGSQLYIYIKRHFLRILDIFEQKVQALAESINPIKTKEVGKLCLRFYNKKNPIHSLRSLRCEMLGEMISVRGQVTRTSDVRPELTLAAFKCNECGNIINGVKQQFRYTQPSKCPSSSCSNMYDWSLVLEQSYFVDWQKIRLQEIAQESPPGSMPRNMDVILRNDIVDSVHAGDRIIVTGCLIVVPDIPTLMKPGDIPRSVARQILKKNENSLVSQGLTGIKGVGVQDLNHKLCIYACQIEKLNNSKKENSFDEQTQVDINCEEILNCDDLKWLRDIAMHPNTIDILAECIAPKIWGNIEIKKGALLMMTGGVQKITSNCKLRGDINMCIVGDPGTAKSEILKYVESFAPRAIFTSGKGSTAAGLTAAVHRDPDQGDTVLEAGALMYADQGICCIDEFDKMDEKDRVAIHEAMEQQTISITKAGIQATLNARASVLAACNPKYGRYDTLKTFAQNVNIPAPLLSRFDLFYTMLDSIDIDKDTSIANHLVSMHCGEEAEKHIRANAGKLDTVKMEVYLELSKRVKPLLTDEAKYKLIHYYVSFRNIEYSPGAQRSMRMTVRQLESLIRLSEAVAKLKFSHFVDIKHVEIACSIFKASMKKISNEKEINLDEEFDKVSNSLLNSKTSKIIQPEDGENKPVESKKVMTIKASEYQYISAIIFEIIKEYEFNNNSESITQDQLIETYLQVYAKAESSEHVDEWIYKLKKIIHRLINQDMKLLSEINEADPDNAILRIHPNYAGPILEGTVSNKNTYGYNTFKNYQTEEKIPEDDVDFQEDIDNF

SEQ ID NO: 182 - protein, 497 aa, Plasmodium vivax
MVKTHVVGSKRLDDPMVKIFQLDERAPMAEPNRREQNGADAEGAKERPPMSASQTNYNIYLPDNQLEDYLSDVQISKNEMTMLYEDMHLGRMFENLVAKLYYSKRINGFVHLYNGQEAISSGIIKNLRPSDFVTSTYRDHVHAISKNVPPRKILNELYGNYYGSTNRGKGGSMHIYSKSENFVGGFGFIGEQIPIAVGLAYSILYKREFPQGGAEVRSGAEALSGTEALGGTSSPSGAAPPLEDADVVACFLGDGTANIGQFFESLNLAATYNLPILFVIENNNWAIGMEGSRSSTDDLQNNYSKGKAFNIETYKVDGNDAISIYKLAKKKINQMRRRECGPVLIEAITYRAKGHSLADPDELRIHEEKASWKKRDPIVHLASYMKKKNIVDESFFEQVKKKTKQILLEAEMDADQNMKKSQDVNICQLLRDNIFAPSEGAPFQADYHQYATYDPLSDSELGEYYEALRREADRKLHNRKPDPSEHFASRDLPLLID

SEQ ID NO: 183 - protein, 1386 aa, Plasmodium vivax
MEEKVESELLRVFARSVSSNFEDIKQSEAKITALYEHPNREDYIRLLLKFVMYPYDEKNQKKNLYDGMLNRNVKIAVMISIKNFVKKSVHSNLESLELSPDLSIQIKHFCMHFLLDVNNEDVRSLDRYFYEILLYLFKFSICDDYDYLLFYLITLYISDGGGDSVVQLLHSDERKKVDDTAKIIDCIMLYVRNKEIMEGLTQDNFFVEYAKFVANLEEIKNVICCRNKSLNDDIVNYINNTKRVYKTNDRHSLFLLSDCTLYGLPGVGVASLSNLVSVVNVVSAVSVDNAANAANAANAANAANGANAAGGGMGGPQFDFPGKGTIANDYNGNVKLVPLATAMAHSSRHHINTTLLRKKLIAMKIIRKIVKKYKTNDYVSKYDLKIILTHIEFPLTLYFVYLYGKFSECSGYLAEKLNVGGGAVAGANALLTGGRAELKPSEAYLQISNCFLAMNYLLQNMHVYLKVFYAIIGVDLPEYFEDNFEVLFNIFNNMLLYDVGMVANFVRVMEVLHGAGGAAQYSAGGAPYSTGAAASYSGGAANLASGQFAPPELSPQELAKLSGNFVQNVLKCKVMLVDVIKLISETYQDESKKYIVKLVFSLTQLLYSEGERNLLCHNYNCLASTIKLIHHMNLNKNDSNPYKDKQFLQKIIERVLHHIRLRRTDIEEILDADLDYFRNDLNKVNSFSVRSAATHFLKTLCDNYFDACFPMLEVRIFAKDSLMFFSASASASTNRADALGRGGVGGGVVSTAISPSTQMQNQFGGLHHGGSAAEESNNLHHVGIDKNDPFYEACNLEYKIQLITCLGQVNLAQNFYEQNVQHILKEFVMTARMKYPDVDSLCYGIHDYDFGARPGGGGGAGGGSGVGGNSGAGGGGISGGYGIPCVAAPPGGGAKCVWLRNEDLFSKQNTIYLLSILKFLLNNRSICIGSNNALDVFAFLHHLLFTDKVMIYCYACLCMNRILNQQISSDLVQAIFTSCLSKTLTRLLFLLKYHVHVKVLNEYILITIMRIFLLCPEKLANLYVPLLLILDSTIKTIINDSHNPLFNHYLFELLTVVISLIYKSHNVSGINQVEEVIISTFSQILQMYVHDFIPYIFQILSIIVDNTCTVQKIHVKILSNLYEMDLWKSTVGNVNGIICVLRSFFKKYQLFEEIIKSNMQQLFNIYHYCLSNKKLSTDSFQIILIIFTYLPVEAYKTFLKPLFVLLFTFLQQYKNDIIKIKVVHALSVLVLKTDVSLFVGTVEQIHAGLIFNVLKNLYMPILDKLINVNEKIIIFLALTKIMSNEKIRGEPFVVEMLSLLNQNITNNELVLKKTKAHHQDVQKDELDKNFEVTYVKLQMINTDNINETVLRDININLELKQNLYNSVFMQICHTNGFSSILQLFSS

SEQ ID NO: 184 - protein, 2099 aa, Plasmodium vivax
MESYIRESKKLTFKGSKGKKLLRYVDISLNNKALHDSHIVELVNILKKYIKVVYNHFYCLNIDLSENYITCTGLKTLLKFILNYHDNIGVHILKLYKNNIKDDGVSLIKQLVYVQKIPMEELHLSHNFVQDDTCKELLLSFVQAKKENSYVYPRYEKYQSHYKHLQIPVWIRLEYNCIQNPKEILKEVEEFAKKKRGYKSNLIICAALKSDKRCCPYKCLNATVRNTPIMHVYMFIHQKDSPAYAISTNGKVGKEERKREFSSPSEVVDAGRMHASAHLQHKAQPEGVERQDGEAALPAKGEARSGAARSAAKSAAKGAAKGAAKGAAKGAAKSGKDKKTAVRKGGANSGKRLSRGSLPHDVSADEEEEEEEEEEEEEEEEEEEEEEEEEEEEEEDDDDDDDDDDDDDDDDDDYSEEEEEDDDDEEDDEDEDDDDDDDDDNDDDDNDYRHKRGKPLKGKEKNGQLPDAAPLYASKNGAAIGAQTNGRDEEDYDEEAEEGEESPNAADPAKKKKGKKKKKKKKKKKKEQVEVSPLEGGCEEAKGSGERGEEGSAVGGESGLGDGSGDESGDDNDNDNDNADRDDCDRRDHRYPREDLFRAVGGDPLRLDGGGEEDALPPELCPPRQDRLNLTSDAASSLPLYIILDCTAVLDMKELWKDSSFLPFSFPGLLYLYNNKLLRSNAEGASGGRGVNGVSQNDAFICLMCSYVANELKLVCQKSEIIRQKMVNLKLNIWDKLSELGIIEFLSVPKDFKEKKKNFLNSSFLTEAQIKLANEYYDISQETLQMIQFSILWSTYIYKIGNKEIIIKNASKEINKGGMKKSKKTIFTEVLYLTSSPNIYSFFEHLYGEDMNMILPLCVTVNQINKYIQDEHSCVVELLSSGRPVGDKGGNFLLDKAFFKAFIKDKCARYLPDGEEGVASIGGATNGGTTNGGTTNGLPSNGGIANGGTSNGLPSNGGIANGGSSKKKKKKGAPPKRSADKLKDGFPSAHDNGTPSMSSLSAATPNCTSRSDKLSPGGKRSDDECVRGSLPIGGTHINTNAYDYLDIKSVKSFSNENISKLCQLESSIQGGPFGMVGINGGGRMAAPMGGDRHSHYNDPSGGANKVKTNVGGRASGEETHKGAEKGNAAVGMYASPIDANNGGNGFGMMMVTPPSGSAKENPQGGKENKGSSLYSMLVNAFNGKKKGAQKGAERGADRATDRATDRGVASGQDKSGNNMFMGAGPNQSVRDSVDPLSSHAGGENSQNEGGHGNNAAAAAAVATRPQLNMSNGKVKSTGADLLDQLMHGGSESAPSQGKAASGLGANGGAATSPQMGIPSNDKATYLGSNNNSGSNHSPAHSLFAFNSSMLKGVAPSGKGDLSFQSQMGTEGGGSGKSGSGIGAGLLGGVNFPMNGAGMGTLANRTTQGNSKQLQKNAVETIIGSDLLNVNEVELNNFMGSIPKSFNDSLSMYLDSSNRNDSCYDGIARGENMMPFFNHSLLKGDAEQDLANLAARAEGHSRAEDHSRGADHSRVTDHTRVADHNRVTDHNRVTDHNRVTDHTRLNEMKNVFELYKVDILNTSLLLEEMILNQNVCKYIPSELYNKILRCYERLDCLLAGLNRVGSLSGLSGLSGLSGLRGVSGASGVSGMSGIGGMSGIGGMSGIGGMSGIDAIGGMNQDILCEDFKSYWDYAFSKNESSPLALLTSGGGSGIGGGGGAAHQDFTDGAGNISANKSGNASNAMFYNTVSGNRGSKSALKSSMLNASSHSANGGIGGGSGPLLASHLNSQNNGAVTPKKSRKKPPMNVSMGSGNNVELGINSMKNNSSQKKFMGGLSDGLDNTGFMNNSPGGNLSGSRNSQMGRNANYGLGQSIPPNRSGNGNQAGARNSGSGSNNAKSKDMKNHNAGPKDRNLNSVETDEYKNVNKLLLLGGNAQNVKMNGEKNPYDHGGGGSGGNAHTEHQEHFPHKMNPYNDGGGSGACDSNLLALIHMKKNIKNGVSSSAGPKAGVNSGGANGGGANSGTANELNGLRNRSYKKLLNNESIGLFNSPANKNTVNEMNLKYLEVLNSQFNFSARENRKNECDPNALNSSVMNFQNDLDKKYKNPLVDLCDKGSVKKL

SEQ ID NO: 185 - protein, 462 aa, Plasmodium vivax
MINLRRESKFILKLRRSMGHWPSLNNGRAKWTPRSGMANHHALTSKRHLSLHEYISIDLLRNNMIPCAQGYAAKTPEEAEEKALELQNLCGDVDLVIKAQILSGGRGVGYFKENNFEGGVHICRNSTEVKEIASKMLRNTLVTKQTGEEGKKCNTVFICERFYIRKERYVALLLDRSSDGIVLLGSSTGGSSIEEISKKNPEAIHKMRIDVQNGFSSGQSREFCEKIGFKNTQLDIATDVIANLYKIFTQYDCTLLEINPFSETNDGRVLCCDAKLNFDDNAEYRQKEIFQKRDLSQENAEEIQAKKFNLNYVSLDGNIACMVNGAGLAMATLDLIVLHSGSPSNFLDVGGGATEDEITEALKIINKNPKAKVCFINILGGIMRCDIIARGIIRAFKEEAAFGKPLIVRLEGTNQDEAEELLRQSGVKCVFCQDMNLAAQKSVAMARIMETAEGAGVRVAFT

SEQ ID NO: 186 - protein, 602 aa, Plasmodium vivax
MAEYLEGEGGAGAEKPVSFEEEVETFLINLHDFVYHRNAEAIKKLFDTDFYAISEIYFKNIRWPSIKLVDVFYKQKNRFHNLIHSLYEELYYRHVFIINDVTLEDRKNSWDNYKCLLNFISSICSDPSGDTNDNVLVMPNVWIYDFLSEYIYQYQSMCHYKLKILKEPEENKEGIDFLIKHSDVFESSIVLEVLHSLLLKAEFVTLSEEERAIFVHNVFHVNNEDLTSRYQFAYFACCVLLKVYVLMGDYYTALKIISYIELSHKALYWKVTLCHISVFYHIAFCYLMLRRYNDCIKVLSQILIYLSKQKVHLSNQQRYQQSQIHKLIDKMYFIVIICHSLSNTRLDETILQNIKENYSGKFYALLQTTNEQAYADLFYKVAPKFIDPLSNISFQLLASFENVQNQTYNSDPMTTQLNIFLKDVSYQKKAFHFISYAKLYHNIQLRKLSSLMNYGQQRRPAEGDTASQENHLGEVQKGEPSPDEALALVSADIMCVKNSGRQLVWKDGPLYKGEVVTSVFGSAFDFYIDMDILNIKTRAQQKIFIDYFLHQINMCKNLSSNLQGTPAPHAYKPKYDNFRRKGKAKPRRSGEAATERWSCQAS

SEQ ID NO: 187 - protein, 262 aa, Plasmodium vivax
MKGSGGDDPHGDGQEGESPKGGGSPNREGPKTGSPKTGSPKASAPKGEENQSERPPNKRSKGKQIDQLIIEEADENTIIPYYLSNLLTNASNPVVFMDVNLGNHFLGKFKFELFQNIVPKTSENFRQFCTGEYKVNNLPVGYKNTTFHRVIKEFMIQGGDFVNYNGSGSLSIYGEIFEDENFDVKHDQEGLLSMANSGPNTNGCQFFITTKKCEWLDGKNVVFGRIIDSDSLILLKKIENVSVTPYIYKPKIPINIVECGEL

SEQ ID NO: 188 - protein, 283 aa, Plasmodium vivax
MLFVDLLNGVNVNYKRKVPICKRPTRSAEYLSNQPLHANRNVEQTSSKNGEASITNHEDEKDENILQQYIYTLSHLTIFDVDRDKSTPLNIALLLKACLASHNYIKNVEIFTSNVKNKEICSFIYERRNDFDAFFKLHVMKYIDFFGNPQIVETLKSSVDNKEMYQRELEIFNQIDGETKLRKDLLEDILFECTRLNKIIQYSLAVNNFNLFSPTVLLKLFTYFKHYGVYYSIFLNNIKKVKYYYQTKDIREEDKRKIEKIVDHYLLTLDRFNHMYEAGHVTL

SEQ ID NO: 189 - protein, 236 aa, Plasmodium vivax
MQPAQSEEQTEAQVPKSQAKIVNELIENKDSICAWCFDVLKNELKNEKLDKAPPLIQSLHKSGFKIPFFVKWMKLNDVKDMGSYDYDAYELNGCIGCLNETDIMELRYYALESALNDTRFYPITLKDFPSLIVTITYLFNFEKCAHVYDWVIGKHGIKISFVVNKRRYSSTFLPEVASQHNFDHQTTVKKLIRKANYRGEINDELLENIQVERYEGVSCSLTHVDYERGKRGEAVR

SEQ ID NO: 190 - protein, 644 aa, Plasmodium vivax
MKISDVLSESILSENGKLKKSGIGMGFGVGIGKGKGETASSENVLEEFEIKSKMRKVCLGIPTKELDVKNILRLLKEPICLFGEDSYDKRKRLKSVLVTKYDKFVKKKNVDNEEEVEEFKNILKRYYIDFSKLYDVNSPEYLKINELEEQLGTKRLKQQSIAAKGITVRSTIKEKFYTESSEALKQARLDLTLKTLPRIFLHKEMINKFQEKFSKDEFERYISLYSEHMKSEFDLFISQLGDDRPLTMGKFSPDNSVFAVSSYNTYINIFNYQNDNYNIVKTLKNGHEDKINCIDWNYPNNYSYYSTLSYRDVQKVDLRLASCSSDRSFCLWRPFTEEDLLDDPGALYRDAREKAATGGKNKGGEHSGEHSADQLSDDEEDPKGAGARAKGDQHNGEGEKKKPNNGSKSDRSGKNGGGGKGHLLCKVKAHDDRINKISFHPLNRHVLTCSEDETIKFFDIETQEELFYQEGHNANVYSATFNPYGNLYLSGDSKGGLMLWDIRTGKNIDKKKMVHNNCIMNINFNPFMPNMFCTCSADNTIKIFDLRNFTVSCNILAHNKIVTDAVFEPTYGRYITSCSFDTFIKIWDSVNFYCTKILYNNDNKVRNVDVSPDGSFISSTSFDRTWKLYKNTQFAEENILAHFF

SEQ ID NO: 191 - protein, 1651 aa, Plasmodium vivax
MIDDILTADESDNNFFDGGIKFFKSDETNSFHSVEPVVASDDEGDEDAEEKEDQDEPGGPHHVEEAAGHGTCTPLGEKLKEGHHSSLTRTAVDNSTPSSNQLCEYKNIILALKKINESVDSAFDCNSVNPFVGEQGRQRIVKKKKKKKIGEPQKEQVKGARQAEQVTGERQTEQKKTAELGRGTKKITPLREQVETGKKKILNGLRPLENCKVRVKGCNTREERIGQLPGEHRSVGVVEEFAGGVVLPRARCVSRRRHHEWNGGLEGEEAEGAQEAEEVEEAEEAEEAEEAEVGVAAAVEAQPARISLRRKGEHSEGNEGAHDGARHLLGGSHFTRKAAKCRGSSPSCTQGFNSIACSMTSSAGGSSTAQGGIDAVEEAIDGVAMDAVVEASSEVAMDAMEEASSEVSIDAIDHVSPHTGANGRGEEKTPCSEDADPLAGMDGEASVGEKGSPGGSPTDHVQRRSIPNGAPPLASPSYHNISDNYSAVYSSRKGEGGCHTWRGKSAKLEDSVQQGKGRSTPFFCVPPNCSDKRQDGEAFPFFCYYGCGKDALQPGWRQRQWSVQSEKTMERRMTIRGRGNSVPSEYTCRRRVSSSTDISSLTYTRSKEMVEGMNRRGLEGRDPSGEPLNHWGEEEPRYHWGEENHRGGCAASERVLPKFKSLSNDVGETHSEGRHFANASVGQSKEECYVGNSQGRGVGRDLGRGLPPWGDHPREGQVEPESGDDREVYPMEGGGRIPLLAPSTRMYSREDVKRGDLFVRGGCGLLVPPFKGLKVGYRSSGGSRQSEKNRRQVDTGQSGEPIRGRSGFRAEKDIFFEAIRNIIRIMKEIRKIKMNLKIERNYSLVIQDKEKKNELEKLIDYLTYQKEVRKKLKKSYFDMINKGLFTFLLRSNRANFFFTEEEVKLLKRWNEIKFTKVGSSSGGNTEGEGGRTNCLGRSGGGSHTEGGPSDRRKILHRLRRLNDVIGQQQRQQHQQQHQQHQQHQQHQQHQQHQQHQQQVEEEGVRINWGDEAMWIGEADGGLWPSGGYPPGEAPRRGGRPRKSKNMDSLRSGYLGSTPSRPIWYESYFAHCEKSQRNSFNIFLCLKNVKRIYISQRFKRRIQNGQIYLSKIYDGEKMLGHVKYILEELLNRSLPEIVCLHINDCFVDATISFFISLILLLFKNVNTIKVIRCHIYYSYLSDFLAYQKRNNLRSMHFVCNSILWTRPPDFRSFRGGVHSARQRENFLLYFNTNYVKKGKGWKRWEGRPNSSGDATTGESCRREDSRDTSLKSCLRGRAPPSNGAATGDYRIVVKRGKEVARFGVDEFYDCFVLGGREAKGGREANGGSQPKGEDNQKITPNKSADPQNNSAAPLINSAAPPINSAAPPINSAAPPINSAAPPPTPANAYNIHSGSGSDANTSEDSLKEELQECLCTFPRKRIEEANFWMLKKLKLCSNKLNDDALMYICTLIKKDKLKNLKVLDLRWNNFTYRSLLALSLALTSTTVSEASEGIHCKRRKLHKLLLSGNNIKSPLYSSFLSSFCTCNFIVVRKLDFSMNLIDSDSFAITFKYFRHIFQLQKKKPKKKNNIGNVFINLDHNNLKNSFYINKLAHLLKKFPSKEWQPNGETPVREPNTGGEDARKGVLLSLQYNNIKRGTWGEDPGGTTSRIRF

SEQ ID NO: 192 - protein, 285 aa, Plasmodium vivax
MELLNLKNEENMSVHTMRYSDLQFETNTDISSIEESPFFSVGDFPNELHSSFDDISDYILVDESDLKRERSDITSCESNMIMATKGGGGGGGGGLGGGVMPIKRNTTVKIKKEMKSASYSEESKTASDNTNHDENKKPGLCRTLGTEGRKRMLKLLRKAYKYNEECKVIMKNKNPPLSISYLPYFNLSMLWQLAEDFGVYNEALKIHKECIKKRNANVRFKQSSKNAANYNLSEMNKATKVSKAEYMSDYMCANMDTQTGEDFDTTNTTLNDEGQGKRKRKKSSI

SEQ ID NO: 193 - protein, 380 aa, Plasmodium vivax
MIRRKLYYSLLFLAFLKTFKINQRWSIFISAWYAHEDVDSDYSHSKLYDVLGVHKYASTEEIKKAYRKLSKKYHPDKAKDKNSNNRFSEIAEAYEILGDEEKRKVYDHHGLEAAKNVESNKMEEDPTDHFNIYESFFGGAGGFRREEMKKADSLTLNVEMSLEQLYKGDFFSVIYTRDVNCLRSDDCIMKKKECSGKGYKTVTQQVAPGFIMQNKMRDENCIDRGKAWNQKCSYCPNGMKEEKTIELTLEVEKGMKNNDKIVFEKKGKQEIGHESGDVIFVIQTKKHKVYERKNNDLHQFYEISLKDALIGFSKDIDHISGAPIRINKQTVTFHNEILKVQNKGMPIKDSNKFGDLYIKFLVQFPKYLTEDQKKAISQFL

SEQ ID NO: 194 - protein, 341 aa, Plasmodium vivax
MNAAAIEVINKLKKEDESNNKCFDCGVPNPDWVSVNHGVFLCINCSGVHRSLGVHISIVRSIKMDIFTDEQLKYLDKGGNKKFQTYLENYGINNFIPERKYRTKAAEHYRKIMKSIVHNSDPPSPLSLDEGKDLINFGQNENMNANEINKNGKNNLYADDQQNFIPSLNTAEILDNVSATFSNFINRAQTMTTNTINNLNKNDLIESTKDTLMNSSSWITEKTKKIAENVSDNPWWEKGQSKIKDVTQNATGWISSISSTVSRTNSNFFFANSEFGATGGPTGTGSVSTNASAEGGQGAAAPDHLASTSSSANADGVSKPSAGENNPAFSRTDTSKSLNKN

SEQ ID NO: 195 - protein, 792 aa, Plasmodium vivax
MKELIESVLQLINPDEETEAYLRERINDEKHIIQKKGVEYLYDLVSTFSDEKIKKSTVADIFNKHMKRENNGVGTDEGKNADGQKLAKMVNLKEYWKKNDVVGYYDPFLGIQEKQINYNTSIPISESIRISKEKEKQRQKQLNLFKEWVKNKIKIPSPVRVHNLLHCSDSSKNKTKIEKMYDIRIDNFTLSIGQRSLLTDTTLKINVMNKYGLIGKNGIGKSTLLAKLARYEIEEIKKDISIACIEQDLFLEDVTVLECVLMVDKLRHDLLTELERLELKKSKSALDGGCPNGETQQGDAKQKREEEAVDQEGEGDEKDIDLKILTIYEKLNSINYLEAEKEASKILCGLGFDSNLQKKKVNSLSGGMRMRLCLSRILFSNNDIILLDEPTNHLDIYTIQFLIDYIKKLNKTCIIVSHDRDFLNEVCTDIIHFHQKELTYYSGNYDQFEKTRVEHLLQQQREHDSIEMKKKHVQKFIDRFRCNSKRAALVQSRIKLLNKLPVVNLEKEETPFSFSFLEPFYTSNVLIRLKNISFKNEMFKNLQIKKNANIIIADTVEDPNGKVNGKSHNGTKGEGETTARSDDYQFRHEFLFKNATFEVDMDSRIAICGVNGSGKTTLIKIILNLIDTFEGELHVSNKANIGYYSQYHVDSLNPIFNSIQQLQYNYSNKNIKEEEAIKYFNKFNIPTNVLYEPIYVLSGGQKSKLALAILAYKNPNILILDEPSNHLDIESVQALIVALNLYKGGLIIISHDTYLIKHVADEIYHINNLTKELIKIDYDFDKYAKLLLENKI

SEQ ID NO: 196 - protein, 327 aa, Plasmodium vivax
MKRKYLCGHNRPLTHVNTNYDGDLLFTTGRDKKFILWRLADGNQIGLYECSGAVYNSDVTYDSKRIACSSAANKVYIFDVYTGETLTVMEENGPVRFVEFNKNPLDQSKIVVATDRLKVEHKRFIKLYDLKSNTVVWKQEHESRCIQVRWCFFDKLILSAHENGEIVIWNAEDGHQMRKIQAHSKEVTNMAFDRDRMIMLTSSADGTATLRDAINFEIINEYTADRPLNTCDISPLFKSEHNPKNHIILAGGQAAEHVTTTATGEGKFQTLLYDIIHANELGSIKGHFGTVHSIKFLPHGDGFVSGGEDGFARIYHFDKDYFIGKYD

SEQ ID NO: 197 - protein, 207 aa, Plasmodium vivax
MNEQRSRDYDYLYKIILIGDSGVGKSCILLRFSDDHFTESYITTIGVDFRFRRIKVGDKMVKLQIWDTAGQERFRTITSAYYRGADGIIIIYDTTDRSSFLHIKEWLNEIEKYTSEETCKLLVGNKSDCKDEMEVSTTEGENKAKELNIAFIETSAKDATNVELAFTMITEELIKKKKKKSVSSLGASQSKVKLAAEDHGPGALCSC

SEQ ID NO: 198 - protein, 217 aa, Plasmodium vivax
MSRSKVFFDISIDNKSAGRIVFELFSDITPRTCENFRSLCAGDKVGSKGKNLHYKNSIFHRIIPQFMCQGGDITHGNGSGGESIYGRSFTDENFKMKHDQPGLLSMANAGPNTNSSQFFITLVPCPWLDGKHVVFGKVIEGMNVVRYMEKEGANSGYVKRPVVVTNCGEMKGQDNSADIQHSGGRSSLEGPRFEGKPIPNPLLGLDSTRTGHHHHHH

SEQ ID NO: 199 - protein, 194 aa, Plasmodium vivax
MVSVKTKVLKNNPSDLEKEIAQCLIDIELSSSSDIKNDAKEIKILSCDLIEVEKIKKKTILIYIPYKIYTTYVRKIQRKLINELEKKTKKYVVLVAKRTILKTKQKTKSFKIIPRSRTLTSVYDSILEDIVAPSEIVGKRISMKADGKRLFKIMLDSKERQRDNIEEKLISFAAVYKRITRRDTVFTLPPTNEK

SEQ ID NO: 200 - protein, 316 aa, Plasmodium vivax
MAEHLARIIGTEEDRVNCPFFWKIGACRHGDQCSRSHYKPNSAQTLVIRHMYDNPPMAVAIAEGQMVEDEVLDKAADHFEEFYEEVFEELMKYGEIEDMVVCDNIGDHIIGNVYIKYTHEDYAEKAVKELNGRFYAGKPLQIEYTPVTDFREARCRQFVDGQCRRGGYCNFMHIKHVPRAVKRKLYKRMYKKFPEYKKRRKTKDGSEDGYHDSHRDRGSRDKHRRDKYGDSHHSSRRRNRSRSRSRNRDDADGDSDGASRRHKHPRRENSAERREKIERWNKEREMKNMQRDDDEQDARQEVTVEEQPRGDGPDQS

SEQ ID NO: 201 - protein, 794 aa, Plasmodium vivax
MGRGLTKLLEISLFVGGFLVIWYVTGEKIFRRKKQIVKENILLILRHLCLEIYKVLNETSKTTKSVYDMIKNEPNTSIELNKLEEVLLNNGYKQRIEDVEKEVLNKFDVTVEDFYEELKNYEKDPDVQKVLNSIKKMYHEALLGIQPKLPSIDESISQDVILNLTSLIYKKKRKIYKEKIDSMIKKNQDFNLNTTFSNAEFFNKLQKSTEHVEEQVVRENQNLVPNLFTFKYLVSYYSDDVLFVQRKKYLESKHGEKMIKILKVKKNKKKKKLTKDNLSNGSFQSSGFQNNGLQNNGLQNNSFKSTPSQNSLTDHTSSDRNFFVSPPDKQDHVGDGDELYRSGNHTGAAKDHDATPTYLEMIPPYHPVGELYQGQAQEGEGDLHEGEQHHQEEVHYLEQDPDHHEGEHYLEQEPDHHEEEHYLEQDPHHQEEDQFESAAPPEEPLINSEQSAQHMEADAEEGAAEGGALLGVASPSDGEVSPDGGHGWMHGELSHGEGDHTKIENDAEREDAVQEDAQQDDAEAVGYPDGGAKTEEPSPIKQVDQDGAPDWNAQPEGEEKQDGPVEEAQQESHVEEAQQESHVEEAQQESHVEEAQQESHVDQTEQHNQEAEKSAAEEGGAVNEELAQEEHEPMKGEADEGKGEDEPLPQQEDSGVAAEMVEAVKEGPPAEELPTGELPKEEYTNEEPNNEEPSHEEPSHEEPSHEEPSHEEPSHEEPSHEEPSHEEPSHEEPSHEEPSHEEPSHEEPSHEEPSLEEPSHEDPQNEEPAGGKKPGLGKNSKKKKHAHKDSKKKK

SEQ ID NO: 202 - protein, 174 aa, Plasmodium yoelii
MKNLSILTYTSIRSLTNLYISQVLSNKNWNEIKKTNQEIFNLNNVQDSKNCSNWNSISIDNETESFNKKEKNNETETVTDSFIKKEKQIANINTQIKDNLYNLENKQIYTIGDVSVITELCSSIIDLLTVIFLSKATHFIKHNLYFYIVLSSCHLFFSYKELQYLLASNNELNK

SEQ ID NO: 203 - DNA, 522 bp, Plasmodium yoelii
atgaaaaatttgagtatactaacatatacctcaataagatctttaacgaatttatatataagtcaagtgctctcaaataaaaactggaatgaaataaaaaaaactaatcaagaaatttttaatttaaataatgtccaagatagtaaaaattgttcaaattggaatagtataagcatcgataatgagactgaaagttttaataaaaaagaaaaaaataatgaaactgaaactgttactgattcatttataaaaaaagaaaaacagattgcaaatattaacacccaaattaaagacaatttatataatttagaaaataaacaaatatatactattggggatgttagtgttataacagaattatgttcttcgattattgatttgttaactgtaattttcttatcaaaagccacacattttataaagcataatttatatttctacattgttttatcatcttgtcatttatttttttcgtacaaagagttgcaatatttattagcttcaaacaatgaactaaataaa

SEQ ID NO: 204 - DNA, 519 bp, Plasmodium yoelii
atgaacaggcaaggtaaatatgacatttttcccccaccccttgaaaaaataaataataataataaaacccaagttcccaaaaagtgcccagagaaaacagaaaaaacagaaaaaacagaaaaaacggaaaaaacggaatatcctttcttagtgaatgatgaacgaagtaatataaaacaccaaagtgaaaataaatgttttaacaaaaatgatatggttaatgaaaaaataaataaagttgaccctaacatactaaataaatataataacctaattttaaatactaacgaaataaatttaataataaatgacaatgcaaattttaaagaattattatctaacaatcaagtctcaaactttatgaacgaatatttaactgcccctcttgaagcaattgccaaatataaaaatgataaaactgttattaattttttggaaatattgtttaaatatatgaatgcaaaacaaaagcatatacatttaaataatatttccgaaacattcacttttggcacaaaa

SEQ ID NO: 205 - protein, 297 aa, Plasmodium yoelii
MRDYTDNDSILLKHGWCEMLKGGVIMDVKNVEQAKIAEKAGAIGVMVLENIPSELRNTDGVARSVDPLKIEEIRKCISINVLAKVRIGHFVEAQILEELKVDMLDESEVLTMADEYNHINKHKFKTPFVCGCTNLGEALRRMSEGASMIRTKGEAGTGNIIEAIKHIRTVNNEIKYLCSLDESEVYNFAKKLRAPIDLILLTRKLKRLPVVNFAAGGIATPADAAMCMQLGMDGVFVGSGIFESENPQKMASSIVMAVSNFNNPKILLNVSLGLGKAMHGNTKVSNKWKNKSEEDNS

SEQ ID NO: 206 - DNA, 891 bp, Plasmodium yoelii
atgagagattacacagataatgattccattctacttaaacatggatggtgtgaaatgttaaaagggggagttataatggatgtaaaaaatgtagagcaagcaaaaatagctgaaaaagctggtgcaataggtgtaatggttttagaaaatattccatctgaacttcgaaatactgatggagtagctagaagtgtagacccattgaaaattgaagagataagaaaatgtatttctataaatgtgttagctaaagttagaataggtcattttgttgaagcacaaattttagaagagctcaaagttgatatgcttgacgaaagtgaagtattaactatggcagatgaatataaccatataaataaacataaatttaaaaccccatttgtatgtggatgtacaaatttaggagaagcattaagaagaatgtcagaaggtgcttctatgataagaaccaaaggtgaagctggaactggaaatataattgaagctattaaacatataagaacagtaaataatgaaataaaatatttatgttcattagatgaaagtgaagtatataattttgctaaaaaacttagagcaccaattgatcttatattacttacgagaaaattaaaaagattaccagttgttaattttgctgctggaggaatagctacacctgcagatgctgctatgtgtatgcaattaggaatggatggtgtttttgtaggatcaggaatatttgaaagtgaaaatcctcaaaaaatggcttcatctatagttatggctgtttctaattttaacaaccccaaaatacttttaaatgttagtttagggttaggaaaagccatgcatggaaatacaaaggtatcaaataagtggaaaaataaaagtgaagaagataattca

SEQ ID NO: 207 - protein, 41 aa, Plasmodium yoelii; identical to SEQ ID NO: 107

SEQ ID NO: 208 - protein, 41 aa, Plasmodium yoelii
KHKFKTPFVCGCTNLGEALRRMSEGASMIRTKGEAGTGNII

SEQ ID NO: 209 - protein, 364 aa, Plasmodium yoelii
MMEIPTEEIKFLKKEDVQNIDLNGMSKKERYEIWRRIPKVELHCHLDLTFSAEFFLKWARKYNLQPNMSDDEILDHYLFTKEGESLAEFIRKAISVSDLYRDYDFIEDLAKWAVIEKYKEGVVLMEFRYSPTFVSSSYGLDVELIHKAFIKGIKNATELLNNKIHVALICISDTGHAAASIKHSGDFAIKHKHDFVGFDHGGREIDLKDHKDVYHSVRDHGLHLTVHAGEDATLPNLNTLYTAINILNVERIGHGIRVSESDELIELVKKKDILLEVCPISNLLLNNVKSMDTHPIRKLYDAGVKVSVNSDDPGMFLSNINDNYEKLYIHLNFTLEEFMIMNNWAFEKSFVSDDVKSELKALYF

SEQ ID NO: 210 - DNA, 1092 bp, Plasmodium yoelii
atgatggaaattccaactgaagaaataaagttcctcaaaaaggaagatgtacaaaacatcgatttaaacggaatgagtaaaaaagaaagatatgaaatatggagaagaattcccaaagttgaattacattgccatttagatttaacattttctgctgaattttttttaaaatgggctcgaaaatataatctacaacctaacatgtcagatgacgaaatacttgatcattatttatttacaaaagaaggagaatcattagcagaatttattagaaaagcaataagtgtttctgatttatatagagattatgattttattgaagatttggccaaatgggcagttattgaaaaatataaagaaggtgttgttttaatggaatttcgatattcaccaacttttgtttcttcatcttatggattagatgtagaattgattcataaagcatttataaaaggaataaaaaatgctacagaattattaaacaataaaatacatgttgcattaatatgtattagtgatactggacatgctgctgctagtattaaacattctggagattttgcaattaaacataaacatgatttcgttggttttgatcatggtggacgtgaaatagatttaaaagatcataaagatgtatatcattcagttagggatcatggtttacatctaactgtacatgcaggtgaagatgcaactttaccaaatctaaatactttatatactgctatcaatattttaaatgttgaacgtattggtcatggtataagagtttcagaatcagatgaactaattgaattagttaaaaaaaaagatatcttattagaagtatgcccaatatctaatcttttattaaataatgttaaatctatggatacacatccaattagaaaattatatgatgctggtgttaaagtatctgttaattccgatgatcctggaatgtttttatcaaacataaatgataattacgaaaaattatatatccatctaaattttacattagaagaatttatgattatgaataactgggcttttgaaaaatctttcgttagtgacgatgttaaaagcgagcttaaagcgttgtacttt

SEQ ID NO: 211 - protein, 24 aa, Plasmodium yoelii
KDAGYQPPLDEKYVKEMSPEEIVN

SEQ ID NO: 212 - protein, 24 aa, Plasmodium yoelii
KDAGYQPPLDEKYVKEMTPEEIVN

SEQ ID NO: 213 - protein, 798 aa, Plasmodium yoelii
MGAYLSAPKTNKESMDGGNLEIDPSRYGLSCMQGWRKNMEDSHICYNNIKVNEIEEVISIYGVFDGHGGPNVSKWISYNFYRIFVKCIKEASDEMKKDNLDKSENYKLKLIKLTLEKTFLKLDEEMLLTENQEKLKKYNASAQETEESDTRENYLYSILNDIISKNISIKAVEKDGKRCLQVVYNKEGNPVEEGSAETPSTSLIEDDYNNKTEELYDEDDSILKDNMNGDDKELEIKENDSEKKNDDNNFKKIDTTTGEVNSNDNIKGIKLEKDEKSEDNTNKIKIEDSDNTNKEQNDLQNKCKSEVNSVDTDTSNLGQDIKNEIKEDNNGSTEINTKRLKKDMNNETDNNIKEEDAINNNIKTEDVKPSALTYDNLKSLGEMTEPEDKLKGNYSNSNDVINDILNSCDDDNSLDLYGKDNIGEGFSYNETITNVIDNNINNNNNNENNNNNNENNNNENNSNENNETNDNNDLYSPDELRLFENYYSNDYEDNIAYSCGSTAIVAVIIKGYLIVANAGDSRAIICFNGNSLGMSTDHKPHLQAEEARIKKAGGYISNGRVDGNLNLTRAIGDLHYKRDPFLSQKDQKISAFPEVTCVTLTPDDEFLFLACDGIWDCKDGQDVVGFVKTRLEKFEELPDNSADLGGNQNTNSEHINSNNNTTNNENSTLKDEANASNNAENGQISNSYDKNINNNNSNIENEDNSNENQNNFNENNDNNFEKDTNGKYDDSPIIERKKYDKFNKLSQICEELCDDCLSNNYKENDGIGCDNMTCLIVQYNPLYKMHTEKKFLNIDDIE

SEQ ID NO: 214 - protein, 924 aa, Plasmodium falciparum
MGAYLSSPKTNKESLDGGNLELDPSRYGLSCMQGWRKNMEDAHICYNNLKFNEIEEDVSIYGVFDGHGGPNVSKWISYNFRRIFIRCLKEANEEMIKKNMKRSENYKLKLIKLTLEKTFLKLDEEMLLSENQEKLKKYSVPTQEDEEESDTRENYIYSILNDIISKNISIKAIEKDGKRCLQVVYNKDGSPVEEGNTDGSATSTLNQDQPEHNQLYEDGNDNNNSNNNNNNNNNNISPNLYGTNGENILRSDENYDSSNLNLGDNQDRKNYDDIENLGDNNNSSNDMLKKDDASSDILTATTSTNDMKDEDKKNNYLVEKNEHMKKENNNCEENSEQNKQVNGMSSYNKALIEGAMGESIDEKGLLNLNDIKTNNILIDNNNDSNNNNNNNNNNNNSSSNDPSMFSTAYAHHCNNNEGTIGDYLNNEENNETNNIKRLKKDICNDEKGNTQNDIKEEDKMRNMETYMNEPIDGVKSELTYDNLKSMEEQEKNGEIEQGINNMIDHFQSNNLLNNDNTNGNINSYTNDDIHNNGSLQGYEQDGLIQNRNNGDEVNNSDIERLAYDEASANVIDNNINNDIHEEDEDDENNNNDEETGEDDCNGVYSSEELRLFENYYSNDYEDNIAYSCGSTALVAVILKGYLIVANAGDSRAIVCFNGNSLGMSTDHKPHLQTEEARIKKAGGYIANGRVDGNLNLTRAIGDLHYKRDPFLPQKDQKISAFPEITCVTLTPEDEFLFLACDGIWDCKDGQDVVGFVKTRLEKFEEIPDDPNNSLDNTENSEHMNTNNNSDQNEKLKSEDQNNINNEQENILNTSNNDFQKNENLLNENNMDNINMQEKSETEEDLDLERDEDKHDAPPVIERKKYEKFNKLSQICEELCDECLSNNYKENDGIGCDNMTCLIVQYNPEYKIHTEKKFLNIDDIE

SEQ ID NO: 215 - protein, 872 aa, Plasmodium vivax
MGAYLSAPKTNKESLDGGNLELDPSRYGLSCMQGWRKNMEDSHICYNNLKLNEIEEDVSIYGVFDGHGGPNVSKWISYNFRRIFLRCIKEASEELTKKNLDKSKNYKLKLIKLTLEKTFLKLDEEMLLTENQEKLKKYSVPTQENEEESDTRENYLYSILNDIISKNISIKAIEKDGKRCLQVVYNKDGNPVEEGNAESSTTLADEENNKSPDLIGSTDSIVKEEDEEEDNEDDEDGDEAAEKEAAKEEGANKDAVKKESCKEGGSAQEGNNKTLKKDDEISEGLTADGGEEKGALKGEIEKGEKTEDDEEQNSGSTEEKTDAEEKNKEANVAEGKPEVDTNKAISTGSGGENKGKAKDEDGKEHADGYADNGESAETNAKRLKKGMNDYSGNEKESNHEEDLSDGASGSTCEPVVKAELTYDNLKCMEEAAAKEAKNNGANGNLPGFDESALRIYEKGSSSSEEGFSYDEAVTNVIDNNISSNTDASNEADDCNGLYSSDELRLFENYYSNDYEDNIAYSCGSTALVAVILKGYLIVANAGDSRAIVCFNGNSLGMSTDHKPHLQEEEARIKKAGGYISNGRVDGNLNLTRAIGDLHYKRDPFLPQKDQKISAFPEVTCVTLTPEDEFLFLACDGIWDCKDGQDVVGFVKTRLEKFEEPTSDETVIDSTDNTNENATTTITTNENIVNSMGSEEKDKSKELEQNEVSKEKKNAEGAGAGPSIGKDKHNKTTAKGTNSNDEGVENGSEKKKTKEEGGLSEDAHGEDDDEEDDEDDEDEESASRMRTHDGLEMDRYDEDDTKFDSAPVIVRKKFEKFNKLSQICEELCDECLSNNYKENDGIGCDNMTCLIVQYNPIYKIHTEKKFLNIDDIE

SEQ ID NO: 216 - protein, 207 aa, Plasmodium yoelii
MGQFKHHKKNFKKNYDNDFKMGKIILGGTYYKSCENDLVIKNALENLVPYFNGRIFLENKEEIGKVEEVLGPINEFYFSVKLKEGILAKSFSSDTKFYIDESQTLPLSRFLPQDKSAEKKNPKKKKTNRDKKKNGNNNVNTNFNKQNKFGSGGKNRNDRNDRNNWNNSGGNKFGGNNFGGGNRNKGNNNFKNRSNSGRKFGNQRGRF

SEQ ID NO: 217 - protein, 209 aa, Plasmodium falciparum
MGFFKKNKRQSFNRNYEGEVQCNNIILGGTFYKHCENDLLLKNELENLVPYFNGRIFLENKEEIGKVDEILGPINEFYFSVKLKEGIRAKSFSSDTHFFIDKSQTLPLSRFLPQEKNSQSLVKKKKKKSNRDKKKNSFNQNNKKPNNYNFKGNNNRNDHNNRNDHNNRNDHNNRNDHNNRNDRNNRNNKNSFRNRSNSSRKFNNQRGRF

SEQ ID NO: 218 - protein, 197 aa, Plasmodium vivax
MGFFKKNRKGSFNRGQESEMKFDKIILGGTFYKHCENDLVIKNKLENLVPYFNGRIFLENKEEIGKVDEILGPINEFYFSVKLKEGIHAKSFSTDTKFFIDQSQTLPLSRFLPQEKKITHQPKKKKRSNREKKQNNMTPNVKKPNNFTFRGNHKNDRGGRNDNNQFKRNSGNFRNDRNNFKNRPNSGRKFGNQRGRF

SEQ ID NO: 219 - protein, 450 aa, Plasmodium yoelii
MNVENIFENEQVNIEEIEVLSNSEIRTRISLIDTEIKILKNEHTRLKNEYKNIQEKIKDNVEKIHLNKMLPYLVANVVESLDLQDEEDEQEPKDEYDLYDNPNNNNNSYGNISKNAPEEGFRDIDDEKKGKCMVIKTSTRQTIFLPVPGLIEASELKPGDLVGVNKDSYLIIDKLPPEYDNRVKAMEVIEKPTEDYSDIGGLDKQIEDLVEAIVLPMLHKEKFEKIGIKPPKGVLMHGPPGTGKTLLARACASQTNATFLKLAGPQLVQMFIGDGAKMVRDAFNLAKEKAPAIIFIDELDAIGTKRFDSELSGDREVQRTMLELLNQLDGFSTDETVKVIAATNRPDTLDPALLRSGRLDRKIELPHPNEESRARILQIHSRKMNVHKDVNFEELARSTDDFNGAQLKAVCVEAGMIALRRGATEIDHEDFIEGITSVLSKKKSTLNYFT

SEQ ID NO: 220 - protein, 439 aa, Plasmodium falciparum
MNVENIFGNEEVNVEEIEKLSNSEIKTRVSLIDTEIKILKNEHARLKNEYKNLQEKIKDNVEKIHLNKMLPYLVANVVESLDLEDEEEENEIKDEYDLYDNNLKLSHEGFRDIDDEKRGKCMVIKTSTRQTIFLPVPGLIDASELKPGDLVGVNKDSYLIIDKLPQEYDNRVKAMEVIEKPSEDYSDIGGLDKQIEDLVEAIVLPMLHKEKFEKIGIKPPKGVLMHGPPGTGKTLLARACASQTNATFLKLAGPQLVQMFIGDGAKMVRDAFNLAKEKAPAIIFIDELDAIGTKRFDSELSGDREVQRTMLELLNQLDGFSTDDTVKVIAATNRPDTLDPALLRSGRLDRKIELPHPNEESRARILQIHSRKMNVHKDVNFEELARSTDDFNGAQLKAVCVEAGMIALRRGATEIDHEDFVEGITSVLSKKKSTLNYFT

SEQ ID NO: 221 - protein, 441 aa, Plasmodium vivax
MNVENIFPNSDVNVEEIEKLTNAEIKTRISLIDTEIKILKNEHTRLKNEYKSLQEKIKDNVEKIHLNKMLPYLVANVVESLDLDDDEESNEPKDEYDLYVDNSKGGNNDQGFRDIDDEKRGKCMVIKTSTRQTIFLPVPGLIEASELKPGDLVGVNKDSYLIIDKLPPEYDNRVKAMEVIEKPSEDYSDIGGLDKQIEDLVEAIVLPMLHKEKFEKIGIKPPKGVLMHGPPGTGKTLLARACASQTNATFLKLAGPQLVQMFIGDGAKMVRDAFNLAKEKAPAIIFIDELDAIGTKRFDSELSGDREVQRTMLELLNQLDGFSTDDTVKVIAATNRPDTLDPALLRSGRLDRKIELPHPNEESRARILQIHSRKMNVHKDVNFEELARSTDDFNGAQLKAVCVEAGMIALRRGATEIDHEDFVEGITSVLSKKKSTLNYFT

SEQ ID NO: 222 - protein, 189 aa, Plasmodium yoelii
MSMKKKALVVVASGSEDVEYITTVDVLRRANIDVTTASIHETEKVQLQSKNTVFADTIIDKVKNDIFDVIIIPGGMKGSNAISDCQVVIEMLRDQKKNNRLYAAICAAPALVLHRHSLIDDVEAVAYPSFESDFKHIGKGRVCVSKNCVTSLGPGTAVEFALKIVELLLDRESALRLASGFLLHPSITF

SEQ ID NO: 223 - protein, 189 aa, Plasmodium falciparum
MSGKKTALVAVASGSEDVEYITVVDVLRRAGVHVTTASVEKSEQVCLQSKNVVLADTTISKVRNNIYDVLVIPGGMKGSNTISECSEFIDMLKEQKANNRLYAAICAAPETVLDRHSLIDDVEAVAYPSFERNFKHIGKGRVCVSKNCITSVGPGSAVEFGLKIVEHLLGRQVALSLASGFLLHPAVTF

SEQ ID NO: 224 - protein, 189 aa, Plasmodium vivax
MSGKKTALVVVASGSEDVEYITTVDVLRRANISVTTASVEETEKVCLQSKNVVIADTTIDKVKDNTFDVIVIPGGMKGSNAISNCPTVIEMLKVQKSSNKFYAAICAAPETVLHRHSLIDDVEAVAYPSFESDFKHIGKGRVCVSKNCITSVGPGSAVEFALKIVEMLLSRDAALNLASGFLLHPSVTF

SEQ ID NO: 225 - protein, 193 aa, Plasmodium yoelii
  misc_feature (18)..(18): Xaa can be any naturally occurring amino acid
MHIEFGNIYIFFFFLYYXVLNMADEFTDDIGVFSKKLLEPVPFVRTNNCIKDVDAELFISAYAKYLKLHNKITFPKWCNFVKTGKGRKLAPLDEDWYFIKTSSILRRLYIHPDIGVGFLRRQFSYKQRRGVAPNHTSLASGKILRSILQQLENIGYVEQNPKKKGRRLTTKGENAINNFARYINKKVYKLEKQ

SEQ ID NO: 226 - protein, 170 aa, Plasmodium falciparum
MAEQFTEDIGVVNKRLLEPVPFVKTNNCIKDVDADLFIRSYATHLKLHNKITYPKWCTFVKTGKGRKLAPLNEDWYFIRASSILRRLYLHPDIGVGFLRRQFSSKQRRGVAPNHTSLASGKILRSILQQLENLGYVEQNPKKKGRRLTTKGENAINNFARYINKKVYNKE

SEQ ID NO: 227 - protein, 172 aa, Plasmodium vivax
MAEEFTEDIGVVNKRLLEPVPFVRTNNCIKDVDSELFIKAYASYLKLHNKITFPKWCNFVKTGKGRKLAPLNEDWYFVKASSILRKLYLSPDIGVGFLRRHYSYKQRRGVAPNHTSLASGKILRSILQQLENLGYVEQNPKKKGRRLTTKGENAINNFARYINKKVYKLDKE

SEQ ID NO: 228 - protein, 796 aa, Plasmodium yoelii
MFLQRILHNLASCKITTVYKIKQVKRIKKKYYIQNFHTFRKNIIIKPKRKVNYVFFSNKPTDIKMNINDSENIEKQIEKISQEISLLIERNESIKIINDDPDIKKEYENNQNLLKEKKKTLNELCSIFSQPLNLVENRSKLESLIKRRLFYTNSFEIYGGVSGLIDYGPSGCLLKYELEKLWRNHFVFYDEMLEIKGTCITPYSVLKTSGHVDRFTDLMIKDIVTKDCYRADKYLSEWLKNKLDEIKDQKNDGNEKREKNFDNSENINNVQTIQEIESILRRLDGMNENEIKDVIKKYNIKSPEKNDLSDPFPFNLMFQTKIGPKENNENDTIEKNINDMNKNNIAFLRPETAQGIFVNFKKLLEYNGGKMPFAGAQIGLGFRNEISPRNGLLRVREFEMGEIEYFFNPEKSKHEKYDLYKHLVLPLYPRTNQLNDNGNVITNMSLEEAVNNGIICNEALAYFLARTYLFLLKCGIKKDGIRYRQHLEKEMAHYANDCWDAEILTSYGYIECVGHADRSAYDLKHHMNATGSNLYGCQKYDKPVDVEFVKIIPNKAKIGMKFKSDQNKIYKILNEKTNEDLLIIEQELNKNQTYILKGYSDQSNDNNNDSFELTRDMISFQKYTKKVQESNFIPNVIEPSFGIGRLIFCILEHSFRVRQFTDDKEERHYLSLPYALSPIKCSVLSISNNKEFYPYIKQIQTILSENNISCKLDNSSVSIGKKYARIDEIGIPFAVTIDFQTLKDKTITLRDRDSMLQIRVNISEVSDIINSLLSQKSSWSDYVQKYGLFIQQNLEN

SEQ ID NO: 229 - protein, 889 aa, Plasmodium falciparum
MIIIVIFLLSMFFFENKTYCFISKINIKNLRHNKNNNNKYHLFASRELRKISSFVLDNRILFNKQKIRKRKFNFFNVYSNKMSDMDNIKEQKENDGCGSLEELIERYVCEISSLIERNECIKGIDDEDLKKEFMENEKLLQDKKMKLKDLYGKPSEELKLVENRTKLENLVKRKFFYTNSFEIYGGASGLFDYGPSGCLLKSELENLWRCHFIYYDEMLEISGSCVTPYQVLKTSGHVDRFTDLMIRDVVTNDCYRADKYLGDFLKAKIEELRKKNTKGDEHVDEKEKKQKRDDDINENKENNKNNENNKNDENNENNKNDENNKNNDNNNNNNNSCNYNCDMVGGLHNGNERLIQKIELILRKLDGMNEEEIKEIIKEYNIKSPLKNDLSEPFPFNLMFQTKIGPKDDNTEDKNKEKCKNVSNNKNLNSTNTNNNMNNVAFLRPETAQGIFVNFKKLLEYNGGKTPFAGAQLGLGFRNEISPRNGLLRVREFQMAEIEYFVNPKKKNHEKYYLFKYLMLPLYPRDNQLTDGVVIKNMTLEEAVEKNIIANEALAYFLARTYLFLLKCGINKDGIRFRQHLKTEMAHYANDCWDAEILTSFGFIEVVGHADRSAYDLQHHMKYTGANLYACEKYNEPIEVEYVKMIPNKAKIGHTFKSEQNKIYACLNEKSNEELLIIDEELSKNNKYILNISNNDSINNECKYELTRDMLSFQKYKKKVQEENFIPNVIEPSFGIGRLIFCILEHSFRIRRFTDDKEERQYLSLPYKLAPIKCSILSISNNKAFYPYIKQIQMLLNQYNISSKIDNSSVSIGKKYARTDEIGIPFAVTIDFQTLKDKTITLRERDSMLQIRISMSHLVDIINSMLHAKKNWNEYIAQYGLFTQQVLDS

SEQ ID NO: 230 - protein, 842 aa, Plasmodium vivax
MRLLGTLLILVPLQVKARCDVLSRVNSKLRRAPLSTVRAKRHSRAAYIVHSPVPKESRRRYSLVGRRVSDHLRSAHPGSAPLRSMEQSHSSAIGSANGPAAADTSRIEEQIERCSQEISALVERNECIRGLNDEELKKEHDANEKSLEEKKRKLKRLYTLPSEPLNLAKNRTKVDNLAKRKLFYTNSFEIYGGSSGLIDYGPSGCLLKSELETLWRYHFIFYDEMLEICGTCITPYNVLKTSGHVDRFTDLMIRDAVTGEFFRADKYIAEWLTSRAEAVKKQEGEQAGDKRDHPLQEQPPHQVASQPHSAEQMMGVVRRLDGMSEQEIKDVIQQYEIKSPAKNEFVGPFPFNLMFQTKIGPKEDAEDASAQRGQPSGSPPSPTDVSYLNSVAFLRPETAQGIFVNFKKLLEYNGGKMPFAGAQIGLGFRNEISPRNGLLRVREFEMAEIEYFVNPERKCHEKYPLFKHLVLPLYPREEQLASGEHSRVVHMEIDEAVTKGIIANEALAYFLARTYLFLLKCGINKDGLRFRQHLPTEMAHYANDCWDAEILTSYGFIEVVGHADRSAYDLKNHIKVTGANLYACEKYDSPVEEEHIKISPNKAKIGMKFKSQQSVIYQWLNERTTEELLAIDEELNRKNSYVVSISPSGASSPPSSFELSRDMVKFEKFKKKVQEKNFIPNVIEPSFGIGRLIFCIIEHSFRTRTFADEKEERHYLSLPYALAPVKCSVLTISNNKTFVPFVKQIQMILNEISISSKIDTSSVSIGKKYARTDEIGIPFAVTIDFQTLKDKTVTLRERDSMLQVRLGLSELPGAVTALLRQKKTWAELVAQCGLFTQQNLDP

SEQ ID NO: 231 - protein, 670 aa, Plasmodium yoelii
MNTEIDIKCVNEIRMLAAELPLEANSGHQGAPIGCAPIAHILWGYVMNYYNEDTEWINRDRFVLSNGHTSSLLYTMLYLTEQGLNLDDLKKFRQLGSLTPGHPENYITKGVEVTTGPLGQGAANAVGMAICAHNLSEKYNTNDFEIFNNYIYALCGDGCMQEGVFCEAASLAGHLGLGRLILIYDDNKITIDGNTELSFTEDIGKKFESFNWEVKIVKDGNTDFEKIYKEIEECKKNLKQPSLIIVQTLSGFGTKVEGSHKSHGLALKDDDIKNAKKNLGLDSEKKFHISDKVKNFYKNVLQKNKENYMKWKETFDKYMLKYPEKGQEILRRFKKELPNNWENVLPKYTVSDSPLATRNLSGIALNCINKILPELIGGSADLTESNCTALKDEKDITKNSFANKYIRYGVREHGMVAISNGIYAYGGFEPFCGTFLNFYTYAFGALRLSALSNHHVLCIATHDSIELGEDGPTHQPIEVLALLRATPNINIIRPADGNEVSGSYLCHFKNSKTPTVLALCRNKVPHLKNTSAEGVLKGAYILEDFENNNDKQKVILSGCGSELHLCFEAKDILKSKHNLNVRIVSFPSWTMFKKQTKEYQTSIMMHNDPKIVRFYIEPASTFGFDTYFNTYIGLDQFGYSAPKNQIWNHLGFTSDNIVKKVLDFIQNQLN

SEQ ID NO: 232 - protein, 672 aa, Plasmodium falciparum
MNIMDNEIDTKCINEIRMLSAELPLEAKSGHQGAPIGCAPIAHILWSYVMNYYNEDTKWINRDRFILSNGHASALLYTMLYLTEQGLSMEDLKSFRQFGSLTPGHPENHITKGVEVTTGPLGQGASNAVGMAIAAHNLADKYNTEEHKIFDNYVYAICGDGCMQEGVFCEAASLAGHLGLGRLILLYDDNKITIDGNTDLSFTENIEKKFEALNWEVRRVEDGNKDYKKILHEIEQGKKNLQQPTLIIVRTACGFGTKVEGTCKSHGLALNDEDLKNAKSFFGLDPQKKFHISDEVKEFYKNVIQKKKENYIKWKNMFDDFSLKYPQVSQEIIRRFQNDLPNNWKDALPKYTPKDAPGATRNLSGIVLNSINKIFPELIGGSADLSESNCTSLKEENDIKKNSYGNKYIRFGVREHGMVAITNGLYAYGGFKPYCGTFLNFYTYAFGALRLAALSNHHILCIATHDSVELGEDGPTHQPIEVLSLLRSTPNLNIIRPADGNEVSGAYLSHFSNPHTPTVIALCRNKVPHLNNTQPEQVLKGAYILEDFDTSNNPKVILTGSGSELHLCFEAKEILKNQHQLNVRIVSFPSWTLFKKQPEDYQYSVMMHNHPNLPRFYIEPASTHGFDTYFNVYIGINQFGYSAPKNKIWEHLGFTPENIVQKVLAFMKNKLK

SEQ ID NO: 233 - protein, 670 aa, Plasmodium vivax
MNGEIDEKCINEIRMLSAELPLKANSGHQGAPIGCAPIAHILWAYVMNYYNEDTSWMNRDRFVLSNGHASALLYTMLYLTKQGLTMEDLKNFRQLESLTPGHPEKHITKGVEVTTGPLGQGASNAVGMAICAHNLAQKYNTQEFPIFNNYVYAICGDGCMQEGVFCEAASLAGHLGVGRLILLYDDNKITIDGNTELSFTEDIEKKFEGLKWEVRKVPNGNTDFAGILTQIEEAKKNTKQPSLIIVQTACGYGTKVEGTCKSHGLALKEEDLKKTKELFGLDPEKQFHISEEVKNFYENIVEKKKENYLKWKKMFCDFTVKYPETAQEIMRRFSKELPHNWVEVLPKYTTSDAPGATRNLSGVALNCINKILPELIGGSADLTESNCTALKEEKDITRDSFANKYIRYGVREHGMVAITNGISAYGGFEPFCATFLNFYTYAFGALRLAALSQYHIFCIATHDSVELGEDGPTHQPIEVLALLRATPNLNVIRPADGNEVSGAYLCHFKNLKTPTLVALCRNKVPHLKNTSAEQVLKGAYVLEDFNNSNDKQKVILAGCGSELHLCFEAKSILTEQHNLNVRIVSFPSWNLFQQQSEEYQQSVMMHHDAKVVRFYIEPASTHGFDTYFNVYLGINQFGYSAPKNQIWEHLGFTPENIVRKVLAFIEAHLG

SEQ ID NO: 234 - protein, 576 aa, Plasmodium yoelii
MAIEVDEETLKIAKEFQKKNEEEIKSKKLKPETIQLDSPSSNLIKINEASCRGRIKISNLLNAPISETEYNNKDKIEKNKYIDQLVVVCGWSKAVRKQGGGRFCFVNLNDGSCHLNLQIVVNQNIDNYDKLLKCGIGCCFRFTGTLILSPVQNTEKKGLLNQNVELTLTDNSIHSFEIYGENLDPQKYPLSKKNHGKEFLREVAHLRPRSYFISSVMRIRNALMLSTHLFFQSRGFICIQTPLITTSDCEGGGEMFTVTTLFNEEGDINSIPKTKKKINNNQIVKREDQNTNELETNNNTNQYIVDFKKDFFSKQAFLTVSGQLSLENLCSSMGDVYTFGPTFRAENSHTSRHLAEFWMIEPEMAFADIYDNMEVAEAYIKYCIRYVLNNNFHDIYYFEENVEKGLIDRLKNILNDNFAKITYTNAIDLLTKYSNNFEVPIKWGMDLQSEHERFISEQIFKKPVIVYNYPKDLKAFYMKLNDDNKTVAAMDVLVPKIGEVIGGSQREDNLELLDKMINEKKLNIESYWWYRQLRKYGTHPHSGFGLGFERLIMLVTGVDNIKDTIPFPRYHGHAEF

SEQ ID NO: 235 - protein, 722 aa, Plasmodium falciparum
MRIYFITLIYFFTLLFLLTKCIKNKNRNKISNISCTYNLSRIRNRPVLTTGTKRRKLRNNFFFLNNYRKMISLCNKIDIKKRFLLPKLQGKYNLYCTTKNVERTRIKDLFKMDIKEAQHKNFKICGWIKSVRTVGKSYFVFVDINDGSYYKNLQVIIDDKIPDYEYILKTSTDDAIECFGELKGSIGKKQNVELCVYDISKNHYIKLFKQMNQDTVEEKEKINDSGNEKDNHNFNSNGHVNNYNDSNNNNNNNNNNYNNNNHVNNYHDSNNINDNIIFTKNSSGHINEDNKTKGAKHNKEDYYVISKKYHTKQYLRNYPHLRARTKLYSSLFRLKSDIIFETFNFLKKKKNYTYINTPILTSNDCEGAGKLFYATTLFDQQIKNEQREEDHMKKGITNEIAGNIKEKCYYQNEHLEYISRHKSISKMEGFDEMLLKNVSSNDCISPNNTESYNTRFENDFFKKACYLNVSSQLSLECLCCSIGDVFTLNPSFRAENSNTFRHLSEFLMLEVELAFSNLKDIIDISEEYIKEMITYALYKSEDVNYLNEYHDKDLKNKLENILNKKFVLITYDEAINILKKENVFYDFQWGKDFSFEEQKYLATNYFKAPVVIINYPTHIKPFYMKLNEDEKTVSCMDIIFPDVGEVVGGSEREINLKNLKKQMENKKLNMKLYDPYIQLRKHGNIPHAGFGIGMDRLIMFLSSINNIRDVVTFPRYPGSLFM

SEQ ID NO: 236 - protein, 759 aa, Plasmodium vivax
MGATFSRLALSTTLLGLLARGVHRGEGRAEASALALQLCGQRGRRRRAGRRAEAYGGRAARRTEAYGGRTTRRTATSGGTTRRTTPGGTPLMRGAFIFKGNAHHSWCISRGTPNALGWSTPPVRRRFFAKVRGGSGSQGGGHDGAHPGGAPNESASVAPHPGGAPHESASVAPHPGGASNEGTSSELLPGEASNERTGRTKIKDILRAQGTHSEGETCTICGWVKSVRTVGKNRFSFIDVNDGSHVKNLQVVVDAGIPNYGEVSRVLTDDAVECSGELKCSLGKKQRVELCVRDAARAHYVRLLGRGEGARSGGGSGGGSEGGSADGEGEKRDDGEGDRRDDGEGDRRDDGEGDRRGKHYAIAKKYHSKEHLRSFPHLRARTKLYSCVFRLKSDVVAETFKFWRERNCTYINTPVLTSNDCEGAGELFHATTLMSRRGSGGGGEANGSDGSGGASGIDQRDERPGEPVKGDPPFCRDFFKKPCYLNVSSQLALECLCCSMGDVFTLNQSFRAEQSNTVRHLSEFLMMEVELAFSNLTSIISLAEEYIKTMVKFALHQSEDVDYIHEHHDRTLKEKLQAVLQKPFAVVTYDEAMQIVKRHVGRVGVAVDPHVAARTDVSQRGGAPPPRADLTFEEQRFLTEVHFRSPVVVVNYPQEIKPFYMALNADGKTVACMDVLLPHVGEVVGGSEREIRIHTLERRMKEKRLDLRLYEPYLQLRRQGNVPHAGFGLGVDRLIMFLTSMSNIRDVVPFPRAPGSLFM

SEQ ID NO: 237 - protein, 142 aa, Plasmodium yoelii
  misc_feature (10)..(10): Xaa can be any naturally occurring amino acid
MHEHITTVYXVILFFYFIFFFYAAFKNMNNHAPLQIASRRNEKTSFRNNDSFMEKKKSRTSLNSTFDEIKGIISKQLSVEEDKIQLNSSFTKDLGADSLDQVELIMALEEHFKITISDQDALKINTVEEAIDFIEKNKKPDA

SEQ ID NO: 238 - protein, 137 aa, Plasmodium falciparum
MKILLLCIIFLYYVNAFKNTQKDGVSLQILKKKRSNQVNFLNRKNDYNLIKNKNPSSSLKSTFDDIKKIISKQLSVEEDKIQMNSNFTKDLGADSLDLVELIMALEEKFNVTISDQDALKINTVQDAIDYIEKNNKQ

SEQ ID NO: 239 - protein, 138 aa, Plasmodium vivax
MMKAILLWFLFVCGVFAFRQSGNNPLCQQSGNRKGRLSYRKTTGGQGATGRRGSAYSLGSTFDDIKKIISKQLSVEEDKIQMESNFTKDLGADSLDIVELIMALEEKFNITISDQDALKISTVQDAIDFIEKNKKSDA

SEQ ID NO: 240 - protein, 227 aa, Plasmodium yoelii
MESDKLKELHEDIEELKTILSKAVRENVKRKISRVIEDMTVEIAKLKLDEFQKPNKINITNSEKNDNNISYSSVPSFAWNQEKNKVTVFLTIKNIQNINKENIISEFNERDFEIKIHNLDLKNYRFCIKKLYDKIIPNKCSIKIKKDLIQVYLIKQDNKHWDNLHFKESPMSKIKPPKINDQSEPSAMLMDMMKQLYQEGDSDMKRTIAKAWCEANEKKNDFVPPAF

SEQ ID NO: 241 - protein, 228 aa, Plasmodium falciparum
MTTEEKINNLNDDLEELNTLLLSVKRENVKAKIQECIENINGEIIKLKINKNQMPNKITETKVQLNDPIVSYNSVQSFAWNQERNKVTIFLTVKNVHTVGEEKISTVFEERSFEIKMNDVDKKHYRFCIKKLCDKIIPNKCSFKVKKDSVHVTLVKQENKHWENLHFKESPMSKIKPPSMDEQAEPSAMLMNMMKQLYQEGDSDMKRTIAKAWCEANEKKSDFSVPNF

SEQ ID NO: 242 - protein, 227 aa, Plasmodium vivax
MESPQVAELNEDIVELNKLLAQAVRENVKEKIKKCIENTTVEIAKLKLEESQTPNKITEKNTPLNDSNISYNSVQSFAWNQEGNKVTVFLTVKDIHTIDKEKISAEFNERNFEVKMHQVNKKNYRFCVKKLHEKIVPGKCSFKVKKDALHVYLIKQDQKYWDNLHFKESPMSKIRAPKMDEQAEPSTMLMNMMKQLYQEGDSDMKRTIAKAWCEANEKKSDFSVPNF

SEQ ID NO: 243 - protein, 501 aa, Plasmodium yoelii
MNIILSIDQSTQSTKLIFFDEELKVLHMNSLNHEQKCFKPGWYEHDPEEIIENLYKLMNEGINVLKEKYKTVVIKCIGITNQRETVIIWDKETGKPLYNAIVWLDTRVESLVTEFSKKYNNDYFQKKTGTYFNTYFSAFKILWLIKNNKTIKEKVKNGTAMIGNINTWLIYNLTKGNCYTDVTNASRTLLMDINTLQWDPEMCKMFGITNMSALPEIKCNCYNFGLVKSEKVPDYSNVPITGCIGDQQSACIGQAIFDEGEAKCTYGTGVFLLVNTGNKIVYSSCGLITTVCYKFNDDDKPNYALEGSIGTAGSGVSWLENVNLIKDTSEVNEIMETCKDTEGVVFVPAFGGLFAPRWRSDARACISGMSFNTSKAHIVRALLEGIVFQLSEIVNSLTSDMNIEMIHLLRCDGGMTKNKAFMQFNADILNTNIEVSKYKEVTALGAAVLAGLGIKLWKDLDSVKSLIRNKEYTFNSNMDAKSRSKKIKEWNKAVNKELLES

SEQ ID NO: 244 - protein, 501 aa, Plasmodium falciparum
MNVILSIDQSTQSTKVFFYDEELNIVHSNNLNHEQKCLKPGWYEHDPIEIMTNLYNLMNEGIKVLKDKYTSVIIKCIGITNQRETVIIWDRITGKPLYNAIVWLDTRVEELVTEFSAKYNNNDIQKKTGTYFNTYFSAFKILWLIQNNPEIKQKIDDGTAVIGNINTWLIFNLTKGNCYTDVTNASRTLLMDINTLQWDEKMCKIFNITNMSVLPEIKSNCSNFGLVKSEHVPDYLNIPITGCIGDQQSACIGQAIFDEGEAKCTYGTGVFLLINTGEKVVYSTCGLITTICYKFNDNDKPKYALEGSIGTAGSGVSWLLKNKLIDDPSEASDIMEKCENTTGVIFVPAFSGLYAPRWRSDARASIYGMTFNTERSHIVRALLEGIAFQLNEIVDSLTSDMGIEMLHVLRCDGGMTKNKPFMQFNSDIINTKIEVSKYKEVTSLGAAVLAGLEVKIWDSLDSVKSLLRRSDAVFHSKMDDKKRKKKTSEWNKAVERTLIQL

SEQ ID NO: 245 - protein, 501 aa, Plasmodium vivax
MKVILSIDQSTQSTKLIFFDEELNVLHTNSLNHEQKCFKPGWYEHDPVEIINNLYTLMNDGMKALKEKNKEVEIKCIGITNQRETVIIWDKLTGKPLYNAIVWLDTRVEDIVAQFSKKYNNDYFQKKTGTYFNTYFSGFKILWLIQNNQEIRKKVEEGSAIIGNVNTWLIYNLTNGNSYTDVTNASRTLLMNINTLEWDEELCKMFGITNMSVLPEIKCNCFNFGEVMSEQVPDYAGVPITGCIGDQQSACIGQAIFDEGEAKCTYGTGVFLLINTGYKVVYSSCGLITTVCYKFNENDQAKYALEGSIGTAGSGVSWLLKNNLISHPSEASYIMENCEDTGGVVFVPAFSGLYAPRWRSDARACITGMTFNTERKHIVRSLLEGIVFQLNEIVCSLISDMGIEMLHVLRCDGGMTKNKAFMQFNSDLINTKIEVSKYSEVTALGAAVLAGLGVKIWEDLDSVKSLIRSSDSTFNSKMDAKSRKRRISEWGKAVERSLLQM

SEQ ID NO: 246 - protein, 832 aa, Plasmodium yoelii
MVNFTVDQVREIMNKTKQIRNMSVIAHVDHGKSTLTDSLVSKAGIISSKHAGDARFTDTRADEQERCITIKSTGISMYFEHDLEDGEGKKPFLINLIDSPGHVDFSSEVTAALRVTDGALVVVDTIEGVCVQTETVLYQALGERIKPVLHVNKVDRALLELQMEVEDIYQTFARTIESVNVIISTYTDKLMGDIQVYPEKGTVSFGSGLQGWAFTLETFSRIYSKKFGIEKSKMMQRLWGNSFYDAKTKKWSKNQQEGYKRGFCQFIMEPILNLCQSIMNDDKEKYTKMLQNIGVELKGDDKLLTGKQLLKKAMQLWLPAGDTLLEMIVTHLPSPATAQKYRVENLYEGPMDDEAANAIRNCDPNGPLMMYISKMVPTSDKGRFYAFGRVFSGTVATGQKVRIQGPHYVPGEKTDLYEKNIQRTVLMMGRYTEQVQDVPCGNTCCLVGVDQYIVKSGTITTFKEAHNIADMKYSVSPVVRVAVKPKDSKQLPKLVDGLKKLAKSDPLVLCTTDESGEHIISGCGELHIEICLKDLKDEYAQIDFIVSDPVVSYRETVTEESTITCLGKSPNKHNRLFMKAYPLAEGLPEDIDKGKVSDKDDPKTRANYLHSNYQWDKNLALKIWAFGPETIGPNLLTDNTSGIQYMNEIKVHCVAAFQWASKEGVLCEENMRGCEFRMLDVHMHADAIHRGAGQIMPACKKCIYACELTAVPRLVEPIYLVDISCPQDVVSGVYSVLNKRRGIVISEDQKLGTPLLKIQAHLPVAESFGFTSALRAATSGQAFPQCVFDHWSVLYDDPFDSNKNSYKIIMNIRERKGIKVEMPQLDNYLDKL

SEQ ID NO: 247 - protein, 832 aa, Plasmodium falciparum
MVNFTVDQVREIMNKTKQIRNMSVIAHVDHGKSTLTDSLVSKAGIISSKNAGDARFTDTRQDEQERCITIKSTGISMYFEHDLEDGEGKKPFLINLIDSPGHVDFSSEVTAALRVTDGALVVVDTIEGVCVQTETVLYQALGERIKPVLHVNKVDRALLELQMEVEDIYQTFARTIESVNVIISTYTDKLMGDIQVYPEKGTVSFGSGLQGWAFTLETFSRIYSKKFGIEKKKMMQRLWGNSFYDAKTKKWSKNQQEGYKRGFCQFIMEPILNLCQSIMNDDKEKYTKMLTNIGVELKGDDKLLTGKQLLKKAMQLWLPAGDTLLEMIVTHLPSPADAQKYRVENLYEGPMDDEAANAIRNCDPNGPLMMYISKMVPTSDKGRFYAFGRVFSGTVATGQKVRIQGPHYVPGEKTDLYEKNIQRTVLMMGRYTEQVQDVPCGNTCCLVGVDQYIVKSGTITTFKEAHNIADMKYSVSPVVRVAVKPKDSKQLPKLVDGLKKLAKSDPLVLCTTDESGEHIISGCGELHIEICLKDLKDEYAQIDFIVSDPVVSYRETVTEESTITCLGKSPNKHNRLFMKAYPLAEGLPEAIDKNKVSDKDDPKTRANYLHSNFQWDKNLALKIWAFGPETIGPNLLTDNTSGIQYMNEIKVHCVAAFQWASKEGVLCEENMRGIEFRMLDVHMHADAIHRGAGQIMPACKKCIYACELTAFPRLVEPIYLVDISCPQDVVSGVYGVLNKRRGIVISEEQKLGTPLLKIQSHLPVSESFGFTSALRAATSGQAFPQCVFDHWSVLYDDPFDSNKNSYKIIMNIRERKGIKVEMPQLDQYLDKL

SEQ ID NO: 248 - protein, 832 aa, Plasmodium vivax
MVNFTVDQVREIMNKTKQIRNMSVIAHVDHGKSTLTDSLVSKAGIISSKHAGDARFTDTRADEQERCITIKSTGISMYFEHDLEDGEGKKPFLINLIDSPGHVDFSSEVTAALRVTDGALVVVDTIEGVCVQTETVLYQALGERIKPVLHVNKVDRALLELQMEVEDIYQTFARTIESVNVIISTYTDKLMGDIQVYPEKGTVSFGSGLQGWAFTLETFSRIYSKKFGIEKSKMMQRLWGNSFYDAKTKKWSKNQQEGYKRGFCQFIMEPILNLCQSIMNDDKDKYTKMLTNIGVELKGDDKNLTGKQLLKKAMQLWLPAGDTLLEMIVTHLPSPATAQKYRVENLYEGPMDDEAANAIRNCDPQGPLMMYISKMVPTSDKGRFYAFGRVFSGTVATGQKVRIQGPHYVPGEKTDLYEKNIQRTVLMMGRYTEQVQDVPCGNTCCLVGVDQYIVKSGTITTFKEAHNIADMKYSVSPVVRVAVKPKDSKQLPKLVDGLKKLAKSDPLVLCQTDESGEHIISGCGELHIEICLKDLKDEYAQIDFIVSDPVVSYRETVTEESSMTCLGKSPNKHNRLFMKAFPLAEGLPEDIDKNKVSDKDDPKARANYLHSNYQWDKNLALKIWAFGPETIGPNLLTDNTSGIQYMNEIKVHCVAAFQWASKEGVLCEENMRGCEFRMLDVHMHADAIHRGAGQIMPACKKCIYACELTAFPRLVEPIYLVDISCPQDVVSGVYSVLNKRRGIVISEDQKLGTPLLKIQAHLPVAESFGFTSALRAATSGQAFPQCVFDHWSVLYDDPFDSNKNSYKIIMNIRERKGIKVEMPQLDNYLDKL

SEQ ID NO: 249 - protein, 494 aa, Plasmodium yoelii
MSEYNLKKDDDSPFYKLDTIKCEVPINSEFNDRINKFVNQLRISYGTLEEFVDNFVYELKKGLEAHRRHPNLWIPHECSFKMLDSCISDIPTGQERGTYYAIDFGGTNFRAVRASLDGNGKIKRDQETYSLKFTGTFSHEKGLLDKHATASQLFDHFAERIKYIMGEFNDLDDNNEKSVGFTFSFPCTSPSINCSILIDWTKGFETGRATNDPVEGRDVCKLMNDAFIRSSVPAKVSCVVNDAVGTLMSCAYQKGKSAPPCYIGIILGTGSNGCYYEPDWKKYKYSGKIINIELGNFDKDLPLSPIDLVMDWYSANRSRQLFEKMISGAYLGEIVRRFMVNVLQSASSKKMWQSDSFNSESGSVVLNDTTPDFRECKKIAKQTWDMDFTDEQIYALRKICEAVYNRSAALAAAAIAAIAKRIKIIEHSKFSCGVDGSLFVKNAWYCNRLKEHLRVILADKAENLIIIPADDGSGKGAAITAAVVSLSSNMKQLP

SEQ ID NO: 250 - protein, 493 aa, Plasmodium falciparum
MSEYDIAKNDVTYTKLDTIECDIPINEELSWRINKFVNQLRISYSTLEEFVDNFVYELKKGLEAHRKHPNLWIPHECSFKMLDSCIANIPTGQEKGTYYAIDFGGTNFRAVRASLDGKGKIKRDQETYSLKFTGSYSHEKGLLDKHATASQLFDHFAERIKYIMGEFNDLDNKEVKSVGFTFSFPCTSPSINCSILIDWTKGFETGRATNDPVEGRDVCKLMNDAFVRAAIPAKVCCVLNDAVGTLMSCAYQKGRGTPPCYIGIILGTGSNGCYYEPEWKKYKYAGKIINIEFGNFDKDLPTSPIDLVMDWYSANRSRQLFEKMISGAYLGEIVRRFMVNVLQSACSKKMWISDSFNSESGSVVLNDTSKNFEDSRKVAKAAWDMDFTDEQIYVLRKICEAVYNRSAALAAGTIAAIAKRIKIIEHSKFTCGVDGSLFVKNAWYCKRLQEHLKVILADKAENLIIIPADDGSGKGAAITAAVIALNADIPQLP

SEQ ID NO: 251 - protein, 493 aa, Plasmodium vivax
MSYYNLEKDDTVYYKLDTIKCDIPINEELQARINKHVNQLRITYSTLEEFVDNFVYELKKGLEAHRRHPNLWIPHECSFKMLDSCIADIPTGQEKGTYYAIDFGGTNFRAVRASLDGNGKIKRDQETYSLKFTGTFSHEKGLLDKHATASQLFDHFAERIKYIMGEFKDLDNPEGKNVGFTFSFPCTSPSINCSILIDWTKGFETGRATNDPVEGRDVCKLMNDAFVRSEVPAKVCCVVNDAVGTLMSCAYQKGKTTPPCYIGIILGTGSNGCYYEPEWKKYKYSGKIINIELGNFDKDLPLSPIDLVMDWHSANRSRQLFEKMISGAYLGEIVRRFMVNVLQSASSEKMWKSDSFNSELGSVVLNDTSPNFEESRKVAKDAWDMDFTDEQIYALRKICESVYNRSAALAAAAIAAIAKRIKIIEHSKFSCGVDGSLFVKNAWYCKRLQEHLKVILADKAENLIIIPADDGSGKGAAITAAVVSQSSSIKQLP

SEQ ID NO: 252 - protein, 312 aa, Plasmodium yoelii
  misc_feature (8)..(8): Xaa can be any naturally occurring amino acid
MAIYEEMXRDKKVYVLGEDVGLYGGSYNVTKNLAHLFGFARVLDTPICENAFMGLGIGSSINGLRPIVEGMNLSFLILAFNQISNNACMLRYMSNGQFNIPLVIRGPGGVGKQLGPEHSQRIESYIMSIPGIKIVACSTPFNARGLLKSAIRENNPVLFLEHVLLYNKEDDIPILPYTLPIDKAEIVKKGNDLTILCYGITRHLAIEASKELSNIGIDVEIIDLISLKPFDLETIKYSLEKTKKCLILDESAGFGGIGAELYSQIVENFSSILSKKPVRLCTKDVPIAYSSKFEEACIIKKEDIIYMATYMT

SEQ ID NO: 253 - protein, 415 aa, Plasmodium falciparum
MGRKRNNIVNIRYNFFLIYFWVIFMYPCETNKGNVKPLNFIKGKNIFLNITKNKVKHLNTINGIETISNVENKNILNDTNYINEMKNIKVRRNISEALHMAIYEEMKKDKGVYVLGEDVGLYGGSYKVTKNLAHFFGFSRVLDTPICENAFMGLGIGSAINDLRPIIEGMNLSFLILAFNQISNNACMMRYMCDGQFNIPIVIRGPGGIGKQLGPEHSQRIESYLMSIPGIKIVSCSTPFNARGLLKSAIRDNNPILFIEHVLLYNYEQEIPLLPYTLPIDKAEVVKNGKDLTVLSYGITRHLASEAAKELTKFNIDIEVIDLISLKPFDMETIEKSLKKTKKCLILDESAGFGGIGAELYTQVIEMFSSYLITKPIRLCTKDIPIAYSNKYEDACIIKKEDIVYMSTYLHSLSS

SEQ ID NO: 254 - protein, 406 aa, Plasmodium vivax
MHNGVMLFLWLGVCLTWSGQSRKEPTKLLSFIGRENHPPGGKRTNTKGYMSANTTVTVGGGNNIATLNEGNYKKELKNVKVKRNISEALHMATYEEMKRDKSVYVLGEDVGLYGGSYKVTKNLAHFFGFARVLDTPICENSFMGLGIGSCINGLRPIVEGMNLSFLILAFNQISNNACMMRYMCDGQFNIPIVIRGPGGIGKQLGPEHSQRIESYLMSVPGIKIVSCSTPFNARGLLKSAIRDNNPVLFLEHVLLYNVEEEIPLLPYTLPIDRAETVRRGNHLTILCYGVTRHVAMEAAKELANINIDVEVIDLISLKPFDLETIGNSLKKTRKCLILDESAGFGGIGAELYTQVVEKFSPFLERRPVRLCTKDVPIAYSSRFEDACIVKKEDVVYMATYMHGQRG

SEQ ID NO: 255 - protein, 169 aa, Plasmodium yoelii
MKINIASIIFIIFSLCLVNDAYGKNKYGKNGKYGSQNVIKKHGEPVINVQDLISDMVRKEEEIVKLTKNKKSLRKINVALATALSVVSAILLGGAGLVMYNTEKGRRPFQIGKSKKGGSAMARDSSFPMNEESPLGFSPEEMEAVASKFRESMLKDGVPAPSNTPNVQN

SEQ ID NO: 256 - protein, 162 aa, Plasmodium falciparum
MKILSVFFLALFFIIFNKESLAEKTNKGTGSGVSSKKKNKKGSGEPLIDVHDLISDMIKKEEELVEVNKRKSKYKLATSVLAGLLGVVSTVLLGGVGLVLYNTEKGRHPFKIGSSDPADNANPDADSESNGEPNAGPQVTAQDVTPEQPQGDDNNLVSGTEH

SEQ ID NO: 257 - protein, 148 aa, Plasmodium vivax
MKLLAAVFLLFCAILCNHALGDNVNGLGAGNPKKKSPKSKSPEPLIDVHELISEIVRKEEELVNMTKKKSNYKLATTVLASALGVVSAVLLGGAGLVFYNAGNGRHPFSLGGGKGGDAAPTEPTPAPTAPSATGLNDDGSSSGTESTS

SEQ ID NO: 258 - protein, 335 aa, Plasmodium yoelii
MTTNQINKRIYIPKFYADANIHKPKEYYDYDNLELQWNKPNRYEILKKVGRGKYSEVFNGYDTEYNRLCAIKVLKPVKKKKIKREIKILQNLHGGPNIIKLLDIVKDPVTKTPSLIFEYINNIDFKTLYPKFTDKDIRYYIYQILKALDYCHSQGIMHRDVKPHNIMIDHENKQIRLIDWGLAEFYHPGQEYNVRVASRYYKGPELLIDLQLYDYSLDIWSLGCMLAGMIFKKEPFFCGHDNYDQLVKIAKVLGTEDLHAYLKKYNIKLKPHYLSILGEYERKPWSHFLNQSNMDIAKDEVIDLIDKMLIYDHAKRIAPKEAMEHPYFKDVREES

SEQ ID NO: 259 - protein, 335 aa, Plasmodium falciparum
MSVSSINKKIYIPKFYADVNIHKPKEYYDYDNLELQWNKPNRYEIMKKIGRGKYSEVFNGYDTECNRPCAIKVLKPVKKKKIKREIKILQNLNGGPNIIKLLDIVKDPVTKTPSLIFEYINNIDFKTLYPKFTDKDIRYYIYQILKALDYCHSQGIMHRDVKPHNIMIDHENRQIRLIDWGLAEFYHPGQEYNVRVASRYYKGPELLIDLQLYDYSLDIWSLGCMLAGMIFKKEPFFCGHDNYDQLVKIAKVLGTEDLHAYLKKYNIKLKPHYLNILGEYERKPWSHFLTQSNIDIAKDEVIDLIDKMLIYDHAKRIAPKEAMEHPYFREVREES

SEQ ID NO: 260 - protein, 382 aa, Plasmodium vivax
MSSSSISKRIYIPKFYADVNIHKPKEYYDYDNLELQWNKPNRYEIMKKIGRGKYSEVFNGYDTEYNRPCAIKVLKPVKKKKIKREIKILQNLHGGPNIIKLLDIVKDPVTKTPSLIFEYINNIDFKTLYPKFTDKDIRYYIYQILKALDYCHSQGIMHRDVKPHNIMIDHENKQIRLIDWGLAEFYHPGQEYNVRVASRYYKGPELLIDLQLYDYSLDIWSLGCMLAGMIFKKEPFFCGHDNYDQLVKIAKVLGTDDLHAYLKKYNIKLKPHYLNILGEYERKPWSHFLTQSNIDIAKDEVIDLIDKMLIYDHAKRIAPKEAMEHPYFSEVREQSKGQDNSADIQHSGGRSSLEGPRFEGKPIPNPLLGLDSTRTGHHHHHH

SEQ ID NO: 261 - protein, 1772 aa, Plasmodium yoelii
MKVIGLLFSFVFFAIKCKSETIEVYNDLIQKLEKLESLSVDGLELFQKSQVIINATQPTETIDPFTNHNFAQQVQDFVTKFEGLGFTEQTELVNLIKALTPNRYGVKYLIESKEEFNGLMHAINFYYDVLRDKLNDMCANNYCEIPEHLKISEEETEMLKKVILGYRKPIENIQDDIEKLEIYIERNKETVAALNALIAEETKKIQPEGNEDCNDASCDSDKYNKKKPIYQAMYNVIFYKKQLAEIQKVVEVLEKRVSTLKKNDAIKPLWQQIEVLNAAPVVTAETQIVTGGQSSTEPGSGGSSASGTSSSGQASAGTGVEQANTVASVTVTPSVGQNGEASTNPQTAQVQPVPTLTLEEKQKKIAGLYAQIKEIAKTIKFNLEGIFVDPIELEYFKKEKKKESCNLSTSSCKKNKASETIIPLTIRYPNGISYPLPENDVYNKIANNAAETTYGDLTHPDNTPLTGDLATNEQARKDLIKAIKKKIKAEEKKLETLKTNYDNKLTEFNQQKTPFKEAAKEFYESKFRNKLTSEIFEKFKTKRDEYMTKKTELNTCEYGNTKELINKLNKQLNYLQDYSLRKDIISNEIEYFSNKKKELQYNINRLAEAVQAKQNVLVASKDVPLSTLVELQIQKSLLTKQIEQLNKTEVSLNKAQLKDKLYVPKTYGNEGKPEPYYLIAVKKEVDRLAQFIPKIESMIAKEKERMEQGPAITGESEEVPSGPSAESSTDRSTQSSTSSSSSSSSTPAAAESSSATLPEAPAPAEAASPSTEASEETTIPPTTQETQPSQAASSTTPAKPVMTKLYYLEKLQKFLVFSYSCHKYVLLQNSTINKDALSKYALTSEEDKIRTLKRCSELDVLLAIQNNMPTMYSLYESIVDGLQNIYTELYEKEMMYHIYKLKDENPSIKSLLVKAGVIEPEPVAAPTPVTPAATEQQQQQATPDVQSDAPAPSDVSQQPETPVTSTTPEVTTSTEASSSAPGEGTPSGEAGASGTEGATASNAATPAGTSASGSAASNASTTSDVTPPAAAAAVPSTSTPAPAQPPAANSQSGNPDSGIRSRAESEEDMPADDFELDNLYKSYLQQIDGNNTEFINFIKSKKELIKALTPEKVNQLYLEIAHLKELSEHYYDRYSTYKLKLERLYNKHEQIQLTNRQIRDLSILKARLLKRKQTLNGVFYILNGYVNFFNKRREAEKQYVDNALKNTDMLLKYYKARTKYFTSEAVPLKTLSKASLDRESNYLKIEKFRAYSRLELRLKKNINLGKERISYVSGGLHHVFEEFKELIKDKDYTGKKNPDNAPEVTNAFEQYKELLPKGVTVSTPAVAVTTTLAADAPATPEGAVPGAVPGAVPGAVPGAVPGAVPGSGTDTRVAGSSVDDNEDDDIYQIASGQSEDAPEKDILSEFTNESLYVYTKRLGSTYKSLKKHMLREFSTIKEDMTNGLNNKSQKRNDFLEVLSHELDLFKDLSTNKYVIRNPYQLLDNDKKDKQIVNLKYATKGINEDIETTTDGIKFFNKMVELYNTQLAAVKEQIATIEAETNDTNKEEKKKYIPILEDLKGLYETVIGQAEEYSEELQNRLDNYKNEKAEFEILTKNLEKYIQIDEKLDEFVEHAENNKHIASIALNNLNKSGLVGEGESKKILAKMLNMDGMDLLGVDPKHVCVDTRDIPKNAGCFRDDNGTEEWRCLLGYKKGEGNTCVENNNPTCDINNGGCDPTASCQNAESTENSKKIICTCKEPTPNAYYEGVFCSSSSFMGLSILLIITLIVFNIF

SEQ ID NO: 262 - protein, 1720 aa, Plasmodium falciparum
MKIIFFLCSFLFFIINTQCVTHESYQELVKKLEALEDAVLTGYSLFQKEKMVLNEEEITTKGASAQSGASAQSGASAQSGASAQSGASAQSGASAQSGTSGPSGPSGTSPSSRSNTLPRSNTSSGASPPADASDSDAKSYADLKHRVRNYLFTIKELKYPELFDLTNHMLTLCDNIHGFKYLIDGYEEINELLYKLNFYFDLLRAKLNDVCANDYCQIPFNLKIRANELDVLKKLVFGYRKPLDNIKDNVGKMEDYIKKNKTTIANINELIEGSKKTIDQNKNADNEEGKKKLYQAQYDLSIYNKQLEEAHNLISVLEKRIDTLKKNENIKKLLDKINEIKNPPPANSGNTPNTLLDKNKKIEEHEEKIKEIAKTIKFNIDSLFTDPLELEYYLREKNKKVDVTPKSQDPTKSVQIPKVPYPNGIVYPLPLTDIHNSLAADNDKNSYGDLMNPHTKEKINEKIITDNKERKIFINNIKKKIDLEEKNINHTKEQNKKLLEDYEKSKKDYEELLEKFYEMKFNNNFNKDVVDKIFSARYTYNVEKQRYNNKFSSSNNSVYNVQKLKKALSYLEDYSLRKGISEKDFNHYYTLKTGLEADIKKLTEEIKSSENKILEKNFKGLTHSANGSLEVSDIVKLQVQKVLLIKKIEDLRKIELFLKNAQLKDSIHVPNIYKPQNKPEPYYLIVLKKEVDKLKEFIPKVKDMLKKEQAVLSSITQPLVAASETTEDGGHSTHTLSQSGETEVTEETEETEETVGHTTTVTITLPPTQPSPPKEVKVVENSIEHKSNDNSQALTKTVYLKKLDEFLTKSYICHKYILVSNSSMDQKLLEVYNLTPEEENELKSCDPLDLLFNIQNNIPAMYSLYDSMNNDLQHLFFELYQKEMIYYLHKLKEENHIKKLLEEQKQITGTSSTSSPGNTTVNTAQSATHSNSQNQQSNASSTNTQNGVAVSSGPAVVEESHDPLTVLSISNDLKGIVSLLNLGNKTKVPNPLTISTTEMEKFYENILKNNDTYFNDDIKQFVKSNSKVITGLTETQKNALNDEIKKLKDTLQLSFDLYNKYKLKLDRLFNKKKELGQDKMQIKKLTLLKEQLESKLNSLNNPHNVLQNFSVFFNKKKEAEIAETENTLENTKILLKHYKGLVKYYNGESSPLKTLSEVSIQTEDNYANLEKFRVLSKIDGKLNDNLHLGKKKLSFLSSGLHHLITELKEVIKNKNYTGNSPSENNKKVNEALKSYENFLPEAKVTTVVTPPQPDVTPSPLSVRVSGSSGSTKEETQIPTSGSLLTELQQVVQLQNYDEEDDSLVVLPIFGESEDNDEYLDQVVTGEAISVTMDNILSGFENEYDVIYLKPLAGVYRSLKKQIEKNIFTFNLNLNDILNSRLKKRKYFLDVLESDLMQFKHISSNEYIIEDSFKLLNSEQKNTLLKSYKYIKESVENDIKFAQEGISYYEKVLAKYKDDLESIKKVIKEEKEKFPSSPPTTPPSPAKTDEQKKESKFLPFLTNIETLYNNLVNKIDDYLINLKAKINDCNVEKDEAHVKITKLSDLKAIDDKIDLFKNPYDFEAIKKLINDDTKKDMLGKLLSTGLVQNFPNTIISKLIEGKFQDMLNISQHQCVKKQCPENSGCFRHLDEREECKCLLNYKQEGDKCVENPNPTCNENNGGCDADATCTEEDSGSSRKKITCECTKPDSYPLFDGIFCSSSNFLGISFLLILMLILYSFI

SEQ ID NO: 263 - protein, 1751 aa, Plasmodium vivax
MKALLFLFSFIFFVTKCQCETESYKQLVAKLDKLEALVVDGYELFHKKKLGENDIKVETNASANNNNNNQVSVLTSKIRNFLSKFLELQIPGHTDLLHLIRELAVEPNGIKYLVESYEEFNQLMHVINFHYDLLRAKLHDMCAHDYCKIPEHLKISDKELDMLKKVVLGYRKPLDNIKDDIGKLETFITKNKITIKNISDLIIAENKKRSGHPTTTTNGAGTQPANGSIAAASSETTQISGSSNSGSSSTGSSNSGSSSTGSSGTGSTGTGQSPPAAADASSTNANYEAKKIIYQAVYNTIFYTNQLQEAQKLIAVLEKRVKVLKEHKDIKVLLEQVAKEKEKLPSDYPNTTNLTNVHKEAESKIAELEKKIEAIAKTVNFDLDGLFTDAEELEYYLREKAKMAGTLIIPESTKSAGTPGKTVPTLKETYPHGISYALAENSIYELIEKIGSDETFGDLQNPDDGKQPKKGILINETKRKELLEKIMNKIKIEEDKLPNLKKEYEEKYKVYEAKVNEFKPAFNHFYEARLDNTLVENKFDDFKKKREAYMEEKKKLESCSYEQNSNLINKLKKQLTYLEDYVLRKDIADDEIKHFSFMEWKLKSEIYDLAQEIRKNENKLTIENKFDFSGVVELQVQKVLIIKKIEALKNVQNLLKNAKVKDDLYIPKVYKTSEKPEPYYLMVLKREIDKLKDFIPKIESMIATEKNKPTVAAADIVAKGQSLRGASETGTTGNTVNAQTAVVQPQHQVVNAVTVQPGTTGHQAQGGEAETQTNSVQAAQVQQTPAGAGGQVASTQTISQAPAPTQASPEPAPAAPPSTPAAAVAPAPTMSKLEYLEKLLDFLKSAYACHKHIFVTNSTMKKELLDQYKLNADEQNKINETKCDELDLLFNVQNNLPAMYSIYDSMSNELQNLYIELYQKEMVYNIYKNKDTDKKIKAFLETLKSKAAAPAQSAAKPSGQAGTTPVTTTAPVTTTTVTPSPQTSVVTSTPPTPQAEENRRVGGNSEEKPEADTAQVEKFYEKHLSQIDKYNDYFQKFLESQKDEITKMDETKWKALGAEIEELKKKLQVSLDHYGKYKLKLERLLKKKNKISNSKDQIKKLTSLKNKLERRQNLLNNPTSVLKNYTAFFNKKRETEKKEVENTLKNTEILLKYYKARAKYYIGEPFPLKTLSEESMQKEDNYLNLEKFRVLSRLEGRLGKNIELEKENISYLSSGLHHVLTELKEIIKNKKYSGNDHTKNIAAVKEALQAYQELIPKVTTQEGASTTAATLPVTVPSAVPGGLPGAGVPGAAAGLTPPPPAGSVPATGPGAAAGSTEENVAAKAQDYAEDYDKVIALPLFGNNDDDGEEDQVTTGEAESEAPEILVPAGISDYDVVYLKPLAGMYKTIKKQLENHVNAFNTNITDMLDSRLKKRNYFLEVLNSDLNPFKYSSSGEYIIKDPYKLLDLEKKKKLIGSYKYIGASIDMDLATANDGVTYYNKMGELYKTHLDGVKTEIKKVEDDIKKQDEELKKLGNVNSQDSKKNEFIAKKAELEKYLPFLNSLQKEYESLVSKVNTYTDNLKKVINNCQLEKKEAEITVKKLQDYNKMDEKLEEYKKSEKKNEVKSSGLLEKLMKSKLIKENESKEILSQLLNVQTQLLTMSSEHTCIDTNVPDNAACYRYLDGTEEWRCLLTFKEEGGKCVPASNVTCKDNNGGCAPEAECKMTDSNKIVCKCTKEGSEPLFEGVFCSSSSFLSLSFLLLMLLFLLCMEL

SEQ ID NO: 264 - protein, 323 aa, Plasmodium yoelii
MMAYKKLCFLAILALSLKAVSANDFSNNDDNIDDENVSDVINIFKNKNHDLYNNPNYISDIKKKFQLLKNQIDQMNKYEKGMSSGDIANILDEDSDDDSNNDEIVFGMSEEDLDNYDDDFWGQNAKKITPVQKGPDANGATLVEGNDEPQVGGGDQGGKVNQGAQVINAVQGGDGLVQGSSGDQVSEDPEPNLEKTAFLGAIFDEILKEQHHDDDVHSTEYHSKYNSLKNECDFPMNLEEYNIAKKLISSYFQSGSTENPIYLYDILLKSLKDEEYKKHFKNFIYGIYSFAKKYNYLSATRLAEANSQFIPNVLKALATVDLK

SEQ ID NO: 265 - protein, 351 aa, Plasmodium falciparum
MKSNIIFYFSFFFVYLYYVSCNQSTHSTPVNNEEDQEELYIKNKKLEKLKNIVSGDFVGNYKNNEELLNKKIEELQNSKEKNVHVLINGNSIIDEIEKNEENDDNEENNDDDNTYELDMNDDTFLGQNNDSHFENVDDDAVENEQEDENKEKSESFPLFQNLGLFGKNVLSKVKAQSETDTQSKNEQEISTQGQEVQKPAQGGESTFQKDLDKKLYNLGDVFNHVVDISNKKNKINLDEYGKKYTDFKKEYEDFVLNSKEYDIIKNLIIMFGQEDNKSKNGKTDIVSEAKHMTEIFIKLFKDKEYHEQFKNYIYGVYSYAKQNSHLSEKKIKPEEEYKKFLEYSFNLLNTM

SEQ ID NO: 266 - protein, 298 aa, Plasmodium falciparum
MIKGLIFYLFICFFVFFVHAVSSQEQPNHTDIYTNEDYKLLEELEKYLDNLKNTFTHKFLENFKGDIELLKKNIQNFEKNNYNNVTGQNVDDYDKNGDNNNHNDLEQNQLLQSNIKSFFGQSRTTNTVDVSASKVTQKSDETKADEKAEQNAEANASSSASSEEQSSSLQNTNDQSFGNTNNPKMDRKNADEQKRDAGLSNLKNIDKLCDELLIYLYKKNEVNTNNYLRKYDEFKNKFDQFLLNVNKYELLKKLILNFFKDNLKDHRAQYKFYIALMKALENEKFSQEFKKVMYGLYS

SEQ ID NO: 267 - protein, 281 aa, Plasmodium falciparum
MKGQAIYFVFVFLYFLNCVGCNSKNNNKRTSYNKKKENLKNFDNIVLDDFYSAFDSQDNYESKLKKNEDDIIGQGIFSLISKKNQEKEKSLKGESEDNTKLQVTKVQGAQVDQAVEPLEKSPEDENKEIPTLDSPQNGNPTSYTSNLSTPPLKRMDEVFDDVLKHLNKEDKVVTDENKNKYNEFKKEFDIFTMNVSEYEIMKNLLITFSKKIDENNQIQTKIENIFNKALKDNKYKEQFKNFIYGLYSFAKRHNYLIVNKTNDTTLHKDLFENALNLINTI

SEQ ID NO: 268 - protein, 372 aa, Plasmodium vivax
MKGVTGPICCLFLFLFSCASSEKLGVQKKKKNLEQDATHALMKKLESLYKLSATDNSEIFNKEIESLKKQIDQLHQHGGENEGESLGHLLESEAANESAKKTIFGVDEDDLDNYDADFIGQSKGKIKGQADTDNQAQRTADVAAQPGGVSPSTSARPQEPGKTGVTGSPNGLVEAGLVNTKTLQNVGPNGQRAADPQPGRAANLPEGQRTNDPQQGGSESTEGPAVTPRPSSTVTPSDANDAKIKYLDKLYDEVLTTSDNTNGIHVPDYHSKYNTIRQKYEYSMNPVEYEIVKNLFNVGFKNDGAASSDATPLVDVFKKALADETFQAEFDNFVHGLYGFAKRHNYLSEARMKDADRYTNLLKNAISLMYTI

SEQ ID NO: 269 - protein, 209 aa, Plasmodium yoelii
MTYLYNFFFFFFFFFSRGKAELIRLIFAYLQVKYTDIRFGVNGDAFAEFNNFKKEKEIPFNQVPILEIGGLILAQSQAIVRYLSKKYNISGNGELNEFYADMIFCGVQDIHYKFNNTNLFKQNETTFLNEELPKWSGYFEKLLQKNNTNYFVGDTITYADLAVFNLYDDIESKYPNCLKNFPLLKAHIELISNIPNIKHYIANRKESVY

SEQ ID NO: 270 - protein, 205 aa, Plasmodium vivax
MAEEIVLYYFDARGKAELIRLIFAYLGIQYTDKRFGENGDAFIEFKNFKKEKETPFNQVPILEMDNIIFAQSQAIVRYLSKKYKISGNSELNEFYADMIFCGVQDIHYKFNNTNLFKQNETTFLNEELPKWSGYFENILKKNNCNYFVGDDLTYADLAVFNLYDDIETKYPNSLKNFPLLKAHNEFISNLPNIKNYISNRKESVY

SEQ ID NO: 271 - protein, 402 aa, Plasmodium yoelii
MDQLKIKRGNFLFTSESVNEGHPDKVCDQISDAILDACLKEDPESKVACEVCAKKNFIFIFGEITTKAKVNYDQVTRNVLKHIGYDDEKKGLDYKNAEIKVFIDEQSPDIAQCVHENKQPELIGAGDQGIMFGYATDETENYMPLTHHYATLLGKRLTEVRKLGILPYLGPDGKTQITIEYKNKASGVYHMEPIRVHTVLISTQHSENVKYEQLKSDLMENVVKYVIPEKLLDKDTLYYLNPSGKFVLGGPAADAGLTGRKIICDTYGGWGAHGGGAFSGKDASKVDRSAAYYLRYIAKSLVANKFCRRVLVQASYSIGIANPVSLNVNSYGTVSTGYTDYDLEQIILRNFDLRPGFIIDELKLKEPIFSKTSAYGHFGRDDKSFTWEKVKDLTHEKNVLKN

SEQ ID NO: 272 - protein, 402 aa, Plasmodium falciparum
MSQLKIKRGNFLFTSESVNEGHPDKICDQISDAILDSCLREDPYSKVACEVCAKKNYIFIFGEITTKAKVNYDKVTRDVLKHIGYDDESKGLDYKTAEIKVSIDEQSPDIAQCVHENRSPELIGAGDQGIMFGYATDETENYMPLTHHYATLLGKRLTEVRKLGILPYLGPDGKTQITIEYKNKGSCGGHLEPLRVHTVLISTQHAEDIKYEQLKTDLMENVIKYVIPEKLLDNETLYYLNPSGKFVLGGPAADAGLTGRKIICDTYGGWGAHGGGAFSGKDASKVDRSAAYYLRFIAKSLVANKFCRRVLVQASYSIGIANPISLNVNSYGTVSTGYTDYDLEQIILRNFDLRPGFIIQELKLTEPVFSKTSAYGHFGREGDTFTWEKIKDLSHEKNALKN

SEQ ID NO: 273 - protein, 402 aa, Plasmodium vivax
MSHLKIKRGNFLFTSESVNEGHPDKVCDQISDAILDACLREDPESKVACEVCAKKNFIFILGEITTKAKVDYDKVARDVLKHIGYDDESKGLDYKTADIKIYIDEQSPDIAQCVHENKKPELIGAGDQGIMFGYATDEAENYMPLTHHYATLLGKRLTEVRKLGILPYLGPDGKTQITIEYKNKGSFGGHMEPLRVHTILISTQHAENVKYEQLKSDLIENVVKYVIPEKLLDEDTLYYLNPSGKFVLGGPAADAGLTGRKIICDTYGGWGAHGGGAFSGKDPSKVDRSAAYYLRYIAKSLVANKFCRRVLVQASYSIGIANPISLNVNSYGTASTGYTDYDLEQIILRNFDLRPGFIIEELKLKEPIFSNTSAYGHFGRSDNSFSWERIKDLTHEKNVLKN

The invention claimed is:

1. A method of inducing a protective immune response against a *Plasmodium* parasite in a mammal, wherein the method comprises administering to the mammal a composition comprising a pharmaceutically acceptable carrier and one or more isolated polypeptides, wherein each of the one or more isolated polypeptides comprises:
   (a) an amino acid sequence comprising at least 20 contiguous amino acid residues of the sequence MKKDREPIDEDEMRITSTGRMTNYVNYGAKILG (SEQ ID NO: 20),
   (b) an amino acid sequence comprising at least 20 contiguous amino acid residues of the sequence KIKATGNAIGKAVTLAEIIKRRFKGLHQIT (SEQ ID NO: 21), or
   (c) an amino acid sequence comprising SEQ ID NO: 22, and wherein each of the one or more isolated polypeptides induces a protective immune response against *Plasmodium falciparum* and/or *Plasmodium vivax* in a mammal.

2. The method of claim 1, wherein the composition comprises an isolated polypeptide comprising at least 20 contiguous amino acid residues of the sequence MKKDREPIDEDEMRITSTGRMTNYVNYGAKILG (SEQ ID NO: 20).

3. The method of claim 2, wherein the composition comprises an isolated polypeptide comprising the amino acid sequence of SEQ ID NO: 20.

4. The method of claim 1, wherein the composition comprises an isolated polypeptide comprising at least 20 contiguous amino acid residues of the sequence KIKATGNAIGKAVTLAEIIKRRFKGLHQIT (SEQ ID NO: 21).

5. The method of claim 4, wherein the composition comprises an isolated polypeptide comprising the amino acid sequence of SEQ ID NO: 21.

6. The method of claim 1, wherein the composition comprises an isolated polypeptide comprising the amino acid sequence of SEQ ID NO: 22.

7. The method of claim 6, wherein the isolated polypeptide comprises the amino acid sequence of KDAGYQPPLDEKYVKEMXPEEIVN (SEQ ID NO: 23), wherein X is a serine (S) residue or a threonine (T) residue.

8. The method of claim 1, wherein the composition comprises a polypeptide comprising the amino acid sequence of SEQ ID NO: 24, SEQ ID NO: 25, or SEQ ID NO: 26.

9. The method of claim 1, wherein the mammal is a human.

10. A method of inducing a protective immune response against a *Plasmodium* parasite in a mammal, wherein the method comprises administering to the mammal a composition comprising a pharmaceutically acceptable carrier and one or more isolated polypeptides, wherein each of the one or more isolated polypeptides comprises:
    (a) an amino acid sequence comprising at least 20 contiguous amino acid residues of the sequence MKKDREPIDEDEMRITSTGRMTNYVNYGAKILG (SEQ ID NO: 20), (b) an amino acid sequence comprising at least 20 contiguous amino acid residues of the sequence KIKATGNAIGKAVTLAEIIKRRFKGLHQIT (SEQ ID NO: 21), and
    (c) an amino acid sequence comprising SEQ ID NO: 22, and wherein each of the one or more isolated polypeptides induces a protective immune response against *Plasmodium falciparum* and/or *Plasmodium vivax* in a mammal.

11. The method of claim 10, wherein the isolated polypeptide comprises the amino acid sequence of KDAGYQPPLDEKYVKEMXPEEIVN (SEQ ID NO: 23), wherein X is a serine (S) residue or a threonine (T) residue.

12. The method of claim 10, wherein one or more isolated polypeptides comprises the amino acid sequences of SEQ ID NO: 20, SEQ ID NO: 21, and SEQ ID NO: 22.

13. The method of claim 12, wherein the isolated polypeptide comprises the amino acid sequence of KDAGYQPPLDEKYVKEMXPEEIVN (SEQ ID NO: 23), wherein X is a serine (S) residue or a threonine (T) residue.

14. The method of claim 13, wherein the mammal is a human.

15. The method of claim 10, wherein the mammal is a human.

16. The method of claim 11, wherein the mammal is a human.

17. The method of claim 12, wherein the mammal is a human.

18. A method of inducing a protective immune response against a *Plasmodium* parasite in a mammal, wherein the method comprises administering to the mammal a composition comprising a pharmaceutically acceptable carrier and one or more polypeptides comprising the amino acid sequence of SEQ ID NO: 24, wherein the *Plasmodium* parasite is *Plasmodium falciparum* or *Plasmodium vivax*.

19. The method of claim 18, wherein the mammal is a human.

20. A method of inducing a protective immune response against a *Plasmodium* parasite in a mammal, wherein the method comprises administering to the mammal a composition comprising a pharmaceutically acceptable carrier and one or more polypeptides comprising the amino acid sequence of SEQ ID NO: 25, wherein the *Plasmodium* parasite is *Plasmodium falciparum* or *Plasmodium vivax*.

21. The method of claim 20, wherein the mammal is a human.

22. A method of inducing a protective immune response against a *Plasmodium* parasite in a mammal, wherein the method comprises administering to the mammal a composition comprising a pharmaceutically acceptable carrier and one or more polypeptides comprising the amino acid sequence of SEQ ID NO: 26, wherein the *Plasmodium* parasite is *Plasmodium falciparum* or *Plasmodium vivax*.

23. The method of claim 22, wherein the mammal is a human.

\* \* \* \* \*